US008017321B2

(12) United States Patent
Bunn, Jr. et al.

(10) Patent No.: US 8,017,321 B2
(45) Date of Patent: Sep. 13, 2011

(54) GEFITINIB SENSITIVITY-RELATED GENE EXPRESSION AND PRODUCTS AND METHODS RELATED THERETO

(75) Inventors: Paul A. Bunn, Jr., Evergreen, CO (US); Christopher D. Coldren, Denver, CO (US); Wilbur A. Franklin, Denver, CO (US); Mark W. Geraci, Aurora, CO (US); Barbara A. Helfrich, Lakewood, CO (US); Fred R. Hirsch, Denver, CO (US); Razvan Lapadat, Denver, CO (US); Michio Sugita, Centennial, CO (US); Samir E. Witta, Greenwood Village, CO (US)

(73) Assignee: The Regents of the University of Colorado, A Body Corporate, Denver, CO (US)

( * ) Notice: Subject to any disclaimer, the term of this patent is extended or adjusted under 35 U.S.C. 154(b) by 0 days.

(21) Appl. No.: 10/587,052

(22) PCT Filed: Jan. 24, 2005

(86) PCT No.: PCT/US2005/002325
§ 371 (c)(1),
(2), (4) Date: Apr. 9, 2007

(87) PCT Pub. No.: WO2005/070020
PCT Pub. Date: Aug. 4, 2005

(65) Prior Publication Data
US 2007/0270505 A1    Nov. 22, 2007

(51) Int. Cl.
*C12Q 1/68* (2006.01)
(52) U.S. Cl. ............................................... 435/6
(58) Field of Classification Search ............ None
See application file for complete search history.

(56) References Cited

U.S. PATENT DOCUMENTS

| | | | |
|---|---|---|---|
| 5,369,108 A | 11/1994 | Breslow et al. |
| 5,445,934 A | 8/1995 | Fodor et al. |
| 5,700,811 A | 12/1997 | Breslow et al. |
| 5,914,269 A | 6/1999 | Bennett et al. |
| 5,932,616 A | 8/1999 | Breslow et al. |
| 6,040,138 A | 3/2000 | Lockhart et al. |
| 6,087,367 A | 7/2000 | Breslow et al. |
| 6,177,248 B1 | 1/2001 | Oliner et al. |
| 6,355,678 B1 | 3/2002 | Uckun et al. |
| 6,511,990 B1 | 1/2003 | Breslow et al. |
| 6,596,878 B2 | 7/2003 | Chen et al. |
| 6,794,392 B1 | 9/2004 | Suzuki et al. |
| 2002/0045591 A1 | 4/2002 | Geiger et al. |
| 2002/0102685 A1 | 8/2002 | Sibilia et al. |
| 2003/0065156 A1 | 4/2003 | Williams et al. |
| 2003/0114504 A1 | 6/2003 | Webster et al. |
| 2003/0190689 A1 | 10/2003 | Crosby et al. |
| 2004/0106141 A1 | 6/2004 | Mischel et al. |
| 2004/0132097 A1 | 7/2004 | Bacus et al. |
| 2004/0132825 A1 | 7/2004 | Bacopoulos et al. |
| 2004/0248151 A1 | 12/2004 | Bacus et al. |
| 2005/0043233 A1 | 2/2005 | Stefanic et al. |
| 2006/0211060 A1 | 9/2006 | Haley et al. |
| 2006/0234237 A1 | 10/2006 | Amler et al. |
| 2007/0020261 A1 | 1/2007 | Sliwkowski et al. |
| 2007/0032513 A1 | 2/2007 | Hennequin et al. |
| 2007/0043009 A1 | 2/2007 | Hennequin et al. |
| 2007/0117815 A1 | 5/2007 | Pluda et al. |
| 2007/0197473 A1 | 8/2007 | Frankel et al. |
| 2007/0197568 A1 | 8/2007 | Bunn et al. |
| 2007/0281934 A1 | 12/2007 | Buggy et al. |
| 2008/0015190 A1 | 1/2008 | Chakravarty et al. |
| 2008/0015216 A1 | 1/2008 | Belvedere et al. |
| 2008/0033015 A1 | 2/2008 | Belvedere et al. |
| 2008/0085874 A1 | 4/2008 | Kushner et al. |
| 2008/0090233 A1 | 4/2008 | Garcia et al. |
| 2008/0096920 A1 | 4/2008 | Belvedere et al. |
| 2008/0182865 A1 | 7/2008 | Witta et al. |
| 2008/0234265 A1 | 9/2008 | Witta et al. |
| 2010/0196366 A1 | 8/2010 | Bunn et al. |

FOREIGN PATENT DOCUMENTS

| | | |
|---|---|---|
| EP | 659439 | 6/1995 |
| EP | 1236474 | 9/2002 |
| EP | 1510221 | 3/2005 |
| WO | WO 92/10588 | 6/1992 |
| WO | WO 95/35505 | 12/1995 |
| WO | WO 97/10365 | 3/1997 |
| WO | WO 02/05791 | 1/2002 |

(Continued)

OTHER PUBLICATIONS

Knowlden et al (Oncogene, 1999, 17:1949-1957).*
Tockman et al (Cancer Res., 1992, 52:2711s-2718s.*
Alberts et al. (Molecular Biology of the Cell, 3rd edition, 1994, p. 465).*
Lewin, B. (Genes VI, Oxford University Press, Inc., NY, Chapter 29, 1997).*
Fu et al (EMBO Journal, 1996, vol. 15, pp. 4392-4401).*
Mallampalli et al. (Biochem. J. vol. 318, 1996, pp. 333-341).*
Greenbaum et al. (Genome Biology, 2003, vol. 4, Issue 9, pp. 117.1-117.8).*
Tockman et al (Cancer Res., 1992, 52:2711s-2718s).*
Engelman et al (Cancer Research, Dec. 2007, 67: 11924-11932).*

(Continued)

*Primary Examiner* — Sean Aeder
(74) *Attorney, Agent, or Firm* — Sheridan Ross, P.C.

(57) ABSTRACT

Disclosed is the identification, provision and use of a panel of biomarkers that predict sensitivity or resistance to gefitinib and other EGFR inhibitors, and products and processes related thereto. Specifically, a method is described for selecting a cancer patient who is predicted to benefit from therapeutic administration of an EGFR inhibitor, an agonist thereof, or a drug having substantially similar biological activity as EGFR inhibitor. Also described is a method to identify molecules that interact with the EGFR pathway to allow or enhance responsiveness to EGFR inhibitors, as well as a plurality of polynucleotides or antibodies for the detection of the expression of genes that are indicative of sensitivity or resistance to EGFR inhibitors, an agonist thereof, or a drug having substantially similar biological activity as EGFR inhibitors. A method to identify a compound with the potential to enhance the efficacy of EGFR inhibitors is also described.

4 Claims, 9 Drawing Sheets

FOREIGN PATENT DOCUMENTS

| | | |
|---|---|---|
| WO | WO 03/101491 | 12/2003 |
| WO | WO 2004/030625 | 4/2004 |
| WO | WO 2004/046386 | 6/2004 |
| WO | WO 2004/063709 | 7/2004 |
| WO | WO 2004/071572 | 8/2004 |
| WO | WO 2004/111273 | 12/2004 |
| WO | WO 2005/027972 | 3/2005 |
| WO | WO 2005/067667 | 7/2005 |
| WO | WO 2005/070020 | 8/2005 |
| WO | WO 2005/094332 | 10/2005 |
| WO | WO 2005/117553 | 12/2005 |
| WO | WO 2006/005941 | 1/2006 |
| WO | WO 2006/005955 | 1/2006 |
| WO | WO 2006/017214 | 2/2006 |
| WO | WO 2006/017215 | 2/2006 |
| WO | WO 2006/061638 | 6/2006 |
| WO | WO 2006/082428 | 8/2006 |
| WO | WO 2006/099396 | 9/2006 |
| WO | WO 2006/110478 | 10/2006 |
| WO | WO 2006/115833 | 11/2006 |
| WO | WO 2006/115835 | 11/2006 |
| WO | WO 2006/115845 | 11/2006 |
| WO | WO 2007/002248 | 1/2007 |
| WO | WO 2007/025044 | 3/2007 |
| WO | WO 2007/029035 | 3/2007 |
| WO | WO 2007/029036 | 3/2007 |
| WO | WO 2007/052073 | 5/2007 |
| WO | WO 2007/055941 | 5/2007 |
| WO | WO 2007/055942 | 5/2007 |
| WO | WO 2007/072080 | 6/2007 |
| WO | WO 2007/087129 | 8/2007 |
| WO | WO 2007/087130 | 8/2007 |
| WO | WO 2007/093827 | 8/2007 |
| WO | WO 2007/100657 | 9/2007 |
| WO | WO 2007/107594 | 9/2007 |
| WO | WO 2007/127137 | 11/2007 |
| WO | WO 2007/136605 | 11/2007 |
| WO | WO 2008/010985 | 1/2008 |
| WO | WO 2008/033745 | 3/2008 |
| WO | WO 2008/033749 | 3/2008 |

OTHER PUBLICATIONS

Sulzer et al (Am JRespir Crit Care Med, 1998, 157:1319-1323).*
Baselga et al., "Phase I Safety, Pharmacokinetic, and Pharmacodynamic Trial of ZD1839, a Selective Oral Epidermal Growth Factor Receptor Tyrosine Kinase Inhibitor, in Patients with Five Selected Solid Tumor Types" Journal of Clinical Oncology, 2002, vol. 20, No. 21, pp. 4292-4302.
Chinnaiyan et al. "Enhancing the anti-tumor activity of ErbB blockade with histone deacetylase (HDAC) inhibition", Journal of Clinical Oncology, 2004 ASCO Annual Meeting Proceedings, vol. 22, No. 14S, 3029.
Deeb et al., "Altered E-Cadherin and Epidermal Growth Factor Receptor Expressions are Associated with Patient Survival in Lung Cancer: A Study Utilizing High-Density Tissue Microarray and Immunochemistry", Modern Pathology, 2004, vol. 17, pp. 430-439.
Witta et al., "Genes and Proteins Involved in Predicting Sensitivity/ Resistance to Gefitinib in Lung Cancer", presented at the Oct. 29, 2004 Meeting for the European Society for Medical Oncology (EMSO), 1 page.
International Preliminary Report on Patentability for International (PCT) Patent Application No. PCT/US2005/002325, issued Jul. 24, 2006.
Al Moustafa et al., Lung Cancer. 37:49-56,2002.
Allan, Nimotuzumab: Evidence of Clinical Benefit without Rash, The Oncologist, May 2005, vol. 10, No. 9, pp. 760-761.
Andrecheck et al. Proc Natl Acad Sc USA 2000; 97:3444-49.
Arteaga, Sem Oncol 2002;29:3-9.
Arteaga., Exp Cell Res 284:122-130,2003.
Bailey et al., Lung Cancer 2003;41 :s71 (abstr).
Barringer, et al., Gene, 89: 117-22 (1990).
Barsky et al., Cancer 73: 1163-1170, 1994.
Bartlett et al., J Pathol 2003; 199:411-7.
Batsche et al., Mol Cell Biol. 18(7):3647-58,1998.
Beste G, Schmidt FS, Stibora T, Skerra A., Small antibody-like proteins with prescribed ligand specificities derived from the lipocalin fold. Proc Natl Acad Sci U S A. Mar. 2, 1999;96(5):1898-903.
Bianco et al., Oncogene 2003;22:2812-22.
Bolos et al., J. Cell Sci. 116:499-511,2003.
Breathnach et al., Cancer 86: 1165-1173, 1999.
Bremnes et al., J Clin Oncol. 20:2417-2428,2002.
Cano et al., Nat. Cell Biol. 2:76-83, 2000.
Cappuzzo et al., J Clin Oncol. 21(14):2658-63,2003.
Cappuzzo et al., J. Natl Cancer Inst 2004;96: 1133-41.
Cappuzzo et al., Proc Am Soc Clin Oncol, 2004; 22 :3004.
Cappuzzo et al. "Epidermal Growth Factor Receptor Gene and Protein and Getinib Sensitivity in Non-Small-Cell Lung Cancer", Journal of the National Cancer Institute, vol. 97, No. 9, May 4, 2005, pp. 1-13.
Chemotherapy in non-small cell lung cancer: a meta-analysis using updated data on individual patients from 52 randomised clinical trials. Non-small Cell Lung Cancer Collaborative Group. BMJ 1995;311:899-909.
Chinnadurai, Mol. Cell 9, 213-224, 2002.
Ciardello and Tortora, Clin Cancer Res 2001;7:2958-70.
Ciardiello et al., Clin Cancer Res 2000;6:2053-63.
Comijn et al., Mol Cell ;7(6): 1267-78,2001.
Conacci-Sorrell et al., J Cell Biol. 163(4):847-57,2003.
Cowley et al., J Pathol. 179: 183-7, 1996.
Cox,J R Stat Soc B 1972;34:187-220.
Datta SR, Genes and Development 1999; 13:2905-27.
de Ruijter et al., Biochem J.370:737-749, 2003.
Demetri et al., N Engl J Med 2002; 347:472-80.
DeRisi J, Penland L, Brown PO, Bittner ML, Meltzer PS, Ray M, Chen Y, Su YA, Trent JM, Use of a cDNA microarray to analyse gene expression patterns in human cancer. Nat Genet. Dec. 1996;14(4):457-60. (Abstract Only).
DiGiuseppe et al., Leukemia 13:1243-1253, 1999.
Druker et al., N Engl J Med 2001; 344: 1031-7.
Drummond et al., "Enhanced Pharmacodynamic and Antitumor Properties of a Histone Deacetylase Inhibitor Encapsulated in Liposomes or ErbB2-Targeted Immunoliposomes", Clin Cancer Res, May 1 2005, 11(2), pp. 3392-3401.
Dumstrei et al., Development; 129(17):3983-94, 2002.
Eger et al. DeltaEF1 is a transcriptional repressor of E-cadherin and regulates epithelial plasticity in breast cancer cells. Oncogene, Mar. 31, 2005, vol. 24, No. 14, pp. 2375-2385.
Frederick et al., Cancer Res 2000; 60, 1383-87.
Fricke et al., Oncology 66(2):150-9,2004.
Fuino et al., "Histon Deacetylase Inhibitor LAQ824 Down-Regulates Her-2 and Sensitizes Human Breast Cancer Cells to Transtuzumab, Taxotere, Gemcitabine, and Epothilone B." Molecular Cancer Therapeutics, 2003, vol. 2, pp. 971-984.
Fukuoka et al., J Clin Oncol. 21:2237-2246,2003.
Furak et al., European J Cardio-Thoracic Surgery 23:818-823,2003.
Gandara et al., Clin Cancer Res, Jun. 15, 2004;10(12 Pt 2):4205s-4209s.
Giaccone et al., J Clin Oncol 2004;22:777-84.
Gore et al., 2004 ASCO Annual Meeting Proceedings vol. 22, No. 14S (Jul. 15 Supplement): 3026, 2004.
Guatelli, et al, Proc. Nat. Acad. Sci. USA, 87: 1874 (1990).
Hacia JG, Brody LC, Chee MS, Fodor SP, Collins FS, Detection of heterozygous mutations in BRCA1 using high density oligonucleotide arrays and two-colour fluorescence analysis. Nat Genet. Dec. 1996;14(4):441-7. (Abstract Only).
Hajra et al., Cancer Res. 62:1613-1618,2002.
Han et al., J Clin Oncol. Apr. 10, 2005;23(11):2493-501. Epub Feb 14, 2005.
Herbst et al., J Clin Oncol. 2002;20:3815-25.
Hidalgo et al.,J Clin Oncol. 2001;19:3267-79.
Hirsch et al., "Evaluation of HER-2/neu gene amplification and protein expression in non-small cell lung carcinomas" Br J Cancer 86: 1449-1456,2002.
Hirsch et al., J Clin Oncol, 2003;21:3798-807.
Hirsch et al., Lung Cancer 41 Suppl 1:S29-42, 2003.
Huelsken et al., Current Opin. Genet. Dev. 11,547-553,2001.

Janmaat et al., Clin Cancer Res 2003;9:2316-26.
Jemal et al., CA Cancer J Clin. 54(1):8-29,2004.
Jiang, Br J Surg 83: 437-446, 1996.
Jorissen et al., Exp Cell Res 284:31-53,2003.
Kaplan and Meier, J Am Stat Assoc 1985;53:457-81.
Kelly et al., J Clin Oncol. 2001; 19:3210-8.
Kim et al., Clinical Cancer Res, 11:2244, 2005.
Kintner, Cell 69: 225-236, 1992.
Kohler and Milstein, Nature 256:495-497, 1975.
Kraker et al. Modulation of histone acetylation by [4-(acetylamino)-N-(2-amino-phenyl) benzamide] in HCT-8 colon carcinoma. Mol. Cancer. Ther., Apr. 2003, vol. 2, No. 4, pp. 401-408.
Kris et al., J. Am. Med. Assoc. 290,2149-2158,2003.
Kris et al., Lung Cancer 2000; Suppl 1;72:233 abstract.
Kwoh, et al., Proc. Natl. Acad. Sci. USA, 86: 1173 (1989).
Landegren, et al., Science, 241: 1077 (1988).
Levitt and Koty, Investig New Drugs 1999;7:213-26.
Levitzki and Gazit, Science 267: 1782-8, 1995.
Lockhart DJ, Dong H, Byrne MC, Follettie MT, Gallo MV, Chee MS, Mittmann M, Wang C, Kobayashi M, Horton H, Brown EL. Expression monitoring by hybridization to high-density oligonucleotide arrays. Nat Biotechnol. Dec. 1996;14(13):1675-80. (Abstract Only).
Lu et al., Cancer Cell. 4(6):499-515, 2003.
Lynch et al., N Engl J Med 350:2129-39,2004.
Mantel N, Cancer Chemother Rep 50:163-170,1966.
Marks et al., J Natl Cancer Inst (Bethesda),92:1210-6, 2000.
Matei et al., Imatinib mesylate (Gleevec) inhibits ovarian cancer cell growth through a mechanism dependent on platelet-derived growth factor receptor alpha and Akt inactivation, Clinical Cancer Research, Jan. 15, 2004, vol. 10, No. 2, pp. 681-690.
Meinkoth et al., 1984, Anal. Biochem. 138, 267-284.
Mendelsohn et al. Status of Epidermal Growth Factor Receptor Antagonists in the Biology and Treatment of Cancer. Journal of Clinical Oncology, Jul. 15, 2003, vol. 21, No. 14, pp. 2787-2799.
Miller et al., J Clin Oncol. 2004;22: 1103-9.
Miller et al., Proc Am Soc Clin Oncol 2003;22 (abstract 2491).
Mitsudomi et al. J Clin Oncol. 23:2513, 2005.
Monnert "Histone Deacetylase Inhibitors", European Journal of Medicinal Chemistry, 2005, vol. 40, pp. 1-13.
Nimannapalli et al. Histone Deacetylase Inhibitor LAQ824 Both Lowers Expression and Promotes Proteasomal Degradation of Bcr-Abl and Induces Apoptosis of Irnatmlb Mesylate-sensitive or -refractory Chronic Myelogenous Leukemia-Blast Crisis Cells. Cancer Research, Aug. 15, 2003, vol. 63, No. 16, pp. 5126-5135.
Ohira et al., Proc Natl Acad Sci USA. 100:10429-10434,2003.
Oken et al., Am J Clin Oncol, 1982; 5:649-655.
Ono et al., Mol Cancer Ther 2004;3 :465-72.
O'Shannessy DJ, Brigham-Burke M, Soneson KK, Hensley P, Brooks I., Determination of rate and equilibrium binding constants for macromolecular interactions using surface plasmon resonance: use of nonlinear least squares analysis methods. Anal Biochem. Aug. 1, 1993;212(2):457-68. (Abstract Only).
Ozawa et al., EMBO J. 8: 1711-1717, 1989.
Paez et al., "EGFR mutations in lung cancer: Correlation with clinical response to gefitinib therapy." Science (Wash DC) 304:1497-500, 2004.
Pao et al., Proc Natl Acad Sci USA 101(36):13306-11, 2004.
Parkin, The Lancet Oncology 2:533-543,2001.
Parra et al., Brit J Cancer, 91: 208-212, 2004.
Patel et al., Lung Cancer 41: S56, 2003 (suppl2).
Pece and Gutkind, J Biol Chem. 275(52):41227-33,2000.
Pece et al., J Biol Chem 274(27):19347-51, 1999.
Perez-Soler et al., J Clin Oncol 2004;22:3238-47.
Perez-Soler et al., Proc. Am. Soc. Clin. Oncol., 20: 310a (1235) 2001.
Polowy et al., Proc Am Soc Clin Oncol 22: 2003 (abstr 2845), pp. 1-3.
Postigo and Dean, Proc. Natl. Acad. Sci. USA 96, pp. 6683-6688, 1999.
Qian et al.,EMBO J. 23:1739-84,2004.
Ranson et al., J Clin Oncol. 2002;20:2240-50.
Reginato et al., Nat Cell Biol. 5(8):733-40, 2003.
Reissmann et al., J Cancer Res Clin Oncol, 1999;125:61-70.
Rosell et al.; Clin Cancer Res 2004;10:1318-25.
Rosivatz et al., Int J Cancer 111(5):711-9, 2004.
Salomon et al., Crit Rev Oncol Hematol, 1995;19:183-232.
Satoh et al., Biocell. 27(1):47-55,2003.
Schiller et al., N Engl J Med 2002;346:92-8.
Schuster SC, Swanson RV, Alex LA, Bourret RB, Simon MI., Assembly and function of a quaternary signal transduction complex monitored by surface plasmon resonance. Nature. Sep. 23, 1993;365(6444):343-7.
Sekido et al., Mol Cell Biol. 14:5692-700, 1994.
Shepherd et al., Journal of Clinical Oncology, 2004 ASCO Annual Meeting Proceedings (Post-Meeting Edition). vol. 22, No. 14S (Jul. 15 Supplement), 2004: 7022.
Sirotnak et al., Clin Cancer Res 2000;6:4885-92.
Slamon et al., N Engl J Med 2001; 344:783-92.
Slamon et al., Science 235:177-182,1987.
Sordella et al., Science 2004;305:1163-7.
Stribling R, Brunette E, Liggitt D, Gaensler K, Debs R., Aerosol gene delivery in vivo. Proc Natl Acad Sci U S A. Dec. 1, 1992;89(23):11277-81.
Sulzer et al., Am J. Respir, 1998, vol. 157, pp. 1319-1323.
Suzuki et al., Lung Cancer;42(1):35-41, 2003.
Therasse et al, J Natl. Cancer Inst. Feb. 2, 2000; 92(3):205-16; available at http://ctep.cancer.gov/forms/TherasseRECISTJNCI.pdf.
Tracy et al,. Cancer Res, 2004; 64:7241-44.
van Grunsven et al., J Biol Chem. 278:26135-26145, 2003.
Verschueren et al., J Biol Chem. 274:20489-98, 1999.
Vogel et al., J Clin Oncol, 2002;20:719-26.
West et al., Advanced bronchioloalveolar carcinoma: a phase II trial ofpaclitaxel by 96-h infusion (SWaG 9714): a Southwest Oncology Group study. Ann Oncol. Jul. 2005;16(7):1076-80. Epub Apr. 28, 2005.
Witta et al. "Overcoming resistance to EGFR inhibitors in NSCLC cell lines by sequential treatment with histone deacetylase inhibitors", Journal of Clinical Oncology, 2005 ASCO Annual Meeting Proceedings, vol. 23, No. 16S, 7083.
Witta et al., "Restoring E-cadherin expression increases sensitivity to epidermal growth factor receptor inhibitors in lung cancer cell lines", Cancer Res., Jan. 15, 2006; 66(2), pp. 944-950.
Wu and Wallace, Genomics, 4: 560 (1989).
Yarden and Sliwkowski, Nat Rev Mol Cell Bioi. 2:127-137,2001.
Zelent et al., Clin Cancer Res 10: 4622-4629,2004.
International Search Report for International (PCT) Patent Application No. PCT/US08/70930, mailed Feb. 6, 2009.
Written Opinion for International (PCT) Patent Application No. PCT/US08/70930, mailed Feb. 6, 2009.
International Preliminary Report on Patentability for International (PCT) Patent Application No. PCT/US2006/009078, issued Sep. 12, 2007.
International Search Report for International (PCT) Patent Application No. PCT/US08/70924, mailed Oct. 7, 2008.
Written Opinion for International (PCT) Patent Application No. PCT/US08/70924, mailed Oct. 7, 2008.
International Search Report for International (PCT) Patent Application No. PCT/US2006/009078, mailed Feb. 22, 2007.
Written Opinion for International (PCT) Patent Application No. PCT/US2006/009078, mailed Feb. 22, 2007.
International Search Report for International (PCT) Patent Application No. PCT/US05/18879, mailed May 2, 2008.
Written Opinion for International (PCT) Patent Application No. PCT/US05/18879, mailed May 2, 2008.
Written Opinion for International Patent Application No. SG 2007/06399-3, mailed Oct. 8, 2008.
Official Action for U.S. Appl. No. 11/781,946, mailed Nov. 19, 2008.
Brognard et al., Akt/protein kinase B is constitutively active in non-small cell lung cancer cells and promotes cellular survival and resistance to chemotherapy and radiation. Cancer Research, 2001, vol. 61, pp. 3986-3997.
Cappuzzo et al., EGFR and HER2 gene copy number and response to first-line chemotherapy in patients with advanced non-small lung cancer. Journal of Thoracic Oncology, 2007. vol. 2, pp. 423-429.
Dziadzuiszko et al., Epidermal growth factor receptor gene copy number and protein level are not associated with outcome of non-small cell lung cancer patients treated with chemotherapy. Annals of Oncology, 2007, vol. 18, pp. 447-452.

Hirsch et al., Combination of EGFR gene copy number and protein expression predicts outcome for advanced non small cell lung cancer patients treated with gefitnib. Annals of Oncology, 2007, vol. 18, pp. 752-760.

Kuwada et al., "Effects of Trastuzumab on epidermal growth factor receptor-dependent and—independent human colon cancer cells" International Journal of Cancer, John Wiley & Sons, Inc. Mar. 20, 2004, pp. 291-301.

Saito et al. Proc. Natl. Acad. Sci. USA. Apr. 1999, vol. 96, pp. 4592-4597.

Supplementary European Search Report for European Application No. 05755989.0, dated Jul. 2, 2009.

Official Action for U.S. Appl. No. 11/781,946, mailed Jul. 27, 2009.

Bruzzese et al. "Synergistic antitumor effect of the histone deacetylase inhibitor suberoylanilide hydroxamic acid (SAHA) in combination with the epidermal growth factor receptor tyrosine kinasse inhibitor gefitinib ('Iressa', ZD1839) in squamous-cell carcinoma of the head and neck derived cell lines" Proc. Amer. Assoc. Cancer Res., vol. 45, 2004, abstract #5625.

Jones, et al., "E-cadherin relates to EGFR expression and lymph node metastasis in primary breast carcinoma," British Journal of Cancer, 1996, vol. 74, pp. 1237-1241.

Shrader et al., "Molecular correlates gefitinib responsiveness in human bladder cancer cells," Molecular Cancer Therapeutics, 2007, vol. 6, pp. 277-285.

Thomson et al., "Epithelial to mesenchymal transition is a determinant of sensitivity of non-small-cell lung carcinoma cell lines and xenografts to epidermal growth factor receptor inhibition," Cancer Research, 2005, vol. 65, pp. 9455-9462.

International Preliminary Report on Patentability for International (PCT) Patent Application No. PCT/US08/70930, mailed Feb. 4, 2010.

U.S. Appl. No. 12/670,053, filed Jan. 21, 2010, Witta et al.

International Preliminary Report on Patentability for International (PCT) Patent Application No. PCT/US08/70930, mailed Feb. 4, 2010.

Written Opinion dated May 30, 2006, for Application No. PCT/US05/02325.

International Search Report dated May 30, 2006, for Application No. PCT/US05/02325.

Christensen et al. "High Levels of HER-2 Expression Alter the Ability of Epidermal Growth Factor Receptor (EGFR) Family Tyrosine Kinase Inhibitors to Inhibit EGFR Phosphorylation in Vivo," Clinical Cancer Research, Dec. 2001, vol. 7, No. 12, pp. 4230-4238.

Hirashima et al. "Protein Overexpression and Gene Amplification of c-erb B-2 in Pulmonary Carcinomas: A Comparative Immunohistochemical and Fluorescence In Situ Hybridization Study," Modern Pathology, Jun. 2001, vol. 14, No. 6, pp. 556-562.

Nakamura et al. "Correlation Between Encoded Protein Overexpression And Copy Number Of The Her2 Gene With Survival in Non-Small Cell Lung Cancer," International Journal of Cancer, Jan. 1, 2003, vol. 103, No. 1, pp. 61-66.

Testa eta I. "Chromosome Abnormalities in Human Non-Small Cell Lung Cancer," Cancer Research, May 1, 1992, vol. 52, 9 Supplemental, pp. 2702s-2706s.

* cited by examiner

US 8,017,321 B2

GEFITINIB SENSITIVITY-RELATED GENE EXPRESSION AND PRODUCTS AND METHODS RELATED THERETO

CROSS-REFERENCE TO RELATED APPLICATIONS

This application is a national stage filing under 35 U.S.C. §371 of PCT Application No. PCT/US2005/022325, filed Jan. 24, 2005, which designated the United States and published in English. PCT Application No. PCT/US2005/022325 claims the benefit of priority under 35 U.S.C. §119(e) from U.S. Provisional Application No. 60/538,682, filed Jan. 23, 2004. The entire disclosure of each of PCT Application No. PCT/US2005/022325 and U.S. Provisional Application No. 60/538,682 is incorporated herein by reference in its entirety.

REFERENCE TO SEQUENCE LISTING

This application contains a Sequence Listing submitted on a compact disc, in duplicate. Each of the two compact discs, which are identical to each other pursuant to 37 CFR §1.52(e)(4), contains the following file: "Sequence_Listing", having a size in bytes of 727 KB, recorded on 24 Jul. 2006. The information contained on the compact disc is hereby incorporated by reference in its entirety pursuant to 37 CFR §1.77(b)(5) and §1.53(e)(5).

FIELD OF THE INVENTION

This invention generally relates to methods to screen for patients that are predicted to benefit from therapeutic administration of gefitinib, as well as methods to identify compounds that interact with the epidermal growth factor receptor (EGFR) pathway to allow or enhance responsiveness to EGFR inhibitors, and products and methods related thereto.

BACKGROUND OF THE INVENTION

Lung Cancer is the leading cause of death from cancer worldwide. Chemotherapy is the mainstay of treatment for lung cancer. However, less than a third of patients with advanced stages of non-small cell lung cancer (NSCLC) respond to the best two chemotherapy drug combinations. Therefore, novel agents that target cancer specific biological pathways are needed.

The epidermal growth factor receptor (EGFR) is one of the most appealing targets for novel therapies for cancer. EGFR plays a major role in transmitting stimuli that lead to proliferation, growth and survival of various cancer types, including, but not limited to, NSCLC. Ligand binding to the EGFR receptor leads to homo- or heterodimerization of EGFR with other ErbB receptors. EGFR is overexpressed in a large proportion of invasive NSCLC and in premalignant bronchial lesions. Bronchioloalveolar carcinoma (BAC), a subtype of non-small cell lung cancer, represents the major form of lung cancer in non-smoking females and is rising in frequency, and epidermal growth factor receptor (EGFR) is expressed with high frequency in BAC. Unfortunately, the response of BACs to conventional chemotherapy is poor. Activation of EGFR leads to simultaneous activation of several signaling cascades including the MAPK pathway, the protein kinase C (PKC) pathway and the PI(3)K-activated AKT pathway (FIG. 1). EGFR signaling translated in the nucleus leads to cancer cell proliferation and survival.

Targeted therapy against the EGFR receptor has produced response rates of 25-30% as first line treatment and 11-20% in $2^{nd}$ and $3^{rd}$ line settings (e.g., chemo-refractory advanced stage NSCLC). For example, in phase II clinical trials, 11-20% of patients with chemo-refractory advanced stage NSCLC responded to treatment with the EGFR tyrosine kinase inhibitor gefitinib (commercially available as Iressa®, ZD1839). A trial evaluating the activity of the EGFR inhibitor, erlotinib (Tarceva®, OSI-774) has been completed and the results will be reported in the near future. A retrospective analysis of 140 patients responding to treatment with gefitinib revealed that the presence of BAC features (p=0.005) and being a never smoker (p=0.007) were the only independent predictors of response to gefitinib. These data suggest that EGFR inhibitor therapy is more active in BAC and in non-smokers.

However, currently, there are no selection criteria for determining which NSCLC patients will benefit from treatment with EGFR inhibitors such as gefitinib. Moreover, EGFR expression does not predict gefitinib sensitivity. Therefore, despite the correlation of tumor histology and smoking history with gefitinib response, it is of great importance to identify molecular molecules that influence gefitinib responsiveness, and to develop adjuvant treatments that enhance the response. To accomplish this goal, there is a need in the art to define critical aspects of EGFR signaling and to identify which molecules interact with the EGFR pathway to dictate responsiveness to EGFR inhibitors.

SUMMARY OF THE INVENTION

One embodiment of the present invention relates to a method to select a cancer patient who is predicted to benefit from therapeutic administration of an EGFR inhibitor, an agonist thereof, or a drug having substantially similar biological activity as EGFR inhibitor. The method includes the steps of: (a) providing a sample of tumor cells from a patient to be tested; (b) detecting in the sample the expression of one or more genes chosen from a panel of genes whose expression has been correlated with sensitivity or resistance to an EGFR inhibitor; (c) comparing the level of expression of the gene or genes detected in the patient sample to a level of expression of the gene or genes that has been correlated with sensitivity or resistance to the EGFR inhibitor; and (d) selecting the patient as being predicted to benefit from therapeutic administration of the EGFR inhibitor, if the expression of the gene or genes in the patient's tumor cells is statistically more similar to the expression levels of the gene or genes that has been correlated with sensitivity to the EGFR inhibitor than to resistance to the EGFR inhibitor.

In one aspect, the panel of genes in (b) is identified by a method comprising: (a) providing a sample of cells that are sensitive or resistant to treatment with the EGFR inhibitor; (b) detecting the expression of at least one gene in the EGFR inhibitor-sensitive cells as compared to the level of expression of the gene or genes in the EGFR inhibitor-resistant cells; and (c) identifying a gene or genes having a level of expression in EGFR inhibitor-sensitive cells that is statistically significantly different than the level of expression of the gene or genes in EGFR inhibitor-resistant cells, as potentially being a molecule that interacts with the EGFR pathway to allow or enhance responsiveness to EGFR inhibitors.

In another aspect, the EGFR inhibitor is gefitinib. In this aspect, step (b) can include, in one embodiment, detecting in the sample the expression of one or more genes chosen from a gene comprising, or expressing a transcript comprising, a nucleic acid sequence selected from the group consisting of SEQ ID NOs:1-194. Step (c) comprises comparing the level of expression of the gene or genes detected in the patient sample to a level of expression of the gene or genes that has been correlated with sensitivity or resistance to gefitinib. Step (d) comprises selecting the patient as being predicted to benefit from therapeutic administration of gefitinib, an agonist thereof, or a drug having substantially similar biological activity as gefitinib, if the expression of the gene or genes in the patient's tumor cells is statistically more similar to the expression levels of the gene or genes that has been correlated with sensitivity to gefitinib than to resistance to gefitinib.

In any of the embodiments above, the method can include detecting expression of at least two genes in (b), at least three genes in (b), at least four genes in (b), at least five genes in (b), at least 10 genes in (b), at least 25 genes in (b), at least 50 genes from in (b), at least 100 genes in (b), at least 150 genes in (b), or up to all of the genes in the panel of genes.

In one aspect of this method, expression of the gene or genes is detected by measuring amounts of transcripts of the gene in the tumor cells. In another aspect, expression of the gene or genes is detected by detecting hybridization of at least a portion of the gene or a transcript thereof to a nucleic acid molecule comprising a portion of the gene or a transcript thereof in a nucleic acid array. In another aspect, expression of the gene is detected by detecting the production of a protein encoded by the gene. In yet another aspect, the method includes detecting expression of at least one gene selected from the group consisting of: E-cadherin (represented by SEQ ID NO:3) and ErbB3 (represented by SEQ ID NO:15 or SEQ ID NO:133). For example, the method can include detecting expression of at least one gene selected from the group consisting of ZEB1 and SIP1.

In one aspect of this method, the method includes comparing the expression of the gene or genes to expression of the gene or genes in a cell from a non-cancerous cell of the same type. In another aspect, the method includes comparing the expression of the gene or genes to expression of the gene or genes in an autologous, non-cancerous cell from the patient. In another aspect, the method includes comparing the expression of the gene or genes to expression of the gene or genes in a control cell that is resistant to the EGFR inhibitor. In yet another aspect, the method includes comparing the expression of the gene or genes to expression of the gene or genes in a control cell that is sensitive to the EGFR inhibitor. In another aspect, control expression levels of the gene or genes that has been correlated with sensitivity and/or resistance to the EGFR inhibitor has been predetermined.

Yet another embodiment of the present invention relates to a method to identify molecules that interact with the EGFR pathway to allow or enhance responsiveness to EGFR inhibitors. The method includes the steps of: (a) providing a sample of cells that are sensitive or resistant to treatment with gefitinib; (b) detecting the expression of at least one gene in the gefitinib-sensitive cells as compared to the level of expression of the gene or genes in the gefitinib-resistant cells; and (c) identifying a gene or genes having a level of expression in gefitinib-sensitive cells that is statistically significantly different than the level of expression of the gene or genes in gefitinib-resistant cells, as potentially being a molecule that interacts with the EGFR pathway to allow or enhance responsiveness to EGFR inhibitors.

Another embodiment of the present invention relates to a plurality of polynucleotides for the detection of the expression of genes that are indicative of sensitivity or resistance to gefitinib, an agonist thereof, or a drug having substantially similar biological activity as gefitinib. The plurality of polynucleotides consists of at least two polynucleotides, wherein each polynucleotide is at least 5 nucleotides in length, and wherein each polynucleotide is complementary to an RNA transcript, or nucleotide derived therefrom, of a gene that is regulated differently in gefitinib-sensitive tumor cells as compared to gefitinib-resistant cells. In one aspect, each polynucleotide is complementary to an RNA transcript, or a polynucleotide derived therefrom, of a gene comprising, or expressing a transcript comprising, a nucleic acid sequence selected from the group consisting of SEQ ID NOs:1-194. In another aspect, the plurality of polynucleotides comprises polynucleotides that are complementary to an RNA transcript, or a nucleotide derived therefrom, of at least two genes comprising, or expressing a transcript comprising, a nucleic acid sequence selected from the group consisting of SEQ ID NOs:1-194. In another aspect, the plurality of polynucleotides comprises polynucleotides that are complementary to an RNA transcript, or a nucleotide derived therefrom, of at least five genes, at least 10 genes, at least 25 genes, at least 50 genes, at least 100 genes, at least 150 genes, or up to all of the genes, comprising, or expressing a transcript comprising, a nucleic acid sequence selected from the group consisting of SEQ ID NOs:1-194. In one aspect, the polynucleotide probes are immobilized on a substrate. In another aspect, the polynucleotide probes are hybridizable array elements in a microarray. In yet another aspect, the polynucleotide probes are conjugated to detectable markers.

Yet another embodiment of the present invention relates to a plurality of antibodies, antigen binding fragments thereof, or antigen binding peptides, for the detection of the expression of genes that are indicative of sensitivity or resistance to gefitinib, an agonist thereof, or a drug having substantially similar biological activity as gefitinib. The plurality of antibodies, antigen binding fragments thereof, or antigen binding peptides consists of at least two antibodies, antigen binding fragments thereof, or antigen binding peptides, each of which selectively binds to a protein encoded by a gene comprising, or expressing a transcript comprising, a nucleic acid sequence selected from the group consisting of SEQ ID NOs:1-194.

Another embodiment of the present invention relates to a method to identify a compound with the potential to enhance the efficacy of EGFR inhibitors. The method includes the steps of: (a) contacting a test compound with a cell that expresses at least one gene, wherein said gene is selected from any one of the genes comprising, or expressing a transcript comprising, a nucleic acid sequence selected from the group consisting of SEQ ID NOs:1-194; (b) identifying compounds selected from the group consisting of: (i) compounds that increase the expression or activity of the gene or genes in (a), or the proteins encoded thereby, that are correlated with sensitivity to gefitinib; and (ii) compounds that decrease the expression or activity of genes in (a), or the proteins encoded thereby, that are correlated with resistance to gefitinib. The compounds are identified as having the potential to enhance the efficacy of EGFR inhibitors. In one aspect of this embodiment, the cell expresses a gene encoding E-cadherin or ErbB3, and wherein step (b) comprises identifying compounds that increase the expression or activity of E-cadherin or ErbB3 or the gene encoding E-cadherin or ErbB3. In another aspect of this embodiment, the cell expresses a gene encoding ZEB1 and SIP1, wherein step (b) comprises identifying compounds that decrease the expression or activity ZEB1 or SIP1 or the gene encoding ZEB1 or SIP1.

Another embodiment of the present invention relates to a method to treat a patient with a cancer, comprising administering to the patient a therapeutic composition comprising a compound identified by the method described above.

Yet another embodiment of the present invention relates to a method to treat a patient with a cancer, comprising administering to the patient a therapeutic composition comprising a compound that upregulates the expression or activity of E-cadherin or ErbB3 or the gene encoding E-cadherin or ErbB3 in the tumor cells of the patient. Another embodiment of the present invention relates to a method to treat a patient with a cancer, comprising administering to the patient a therapeutic composition comprising a compound that downregulates the expression of ZEB1 or SIP1 or the gene encoding ZEB1 or SIP1 in the tumor cells of the patient.

BRIEF DESCRIPTION OF THE FIGURES OF THE INVENTION

DETAILED DESCRIPTION OF THE INVENTION

Figure 1:
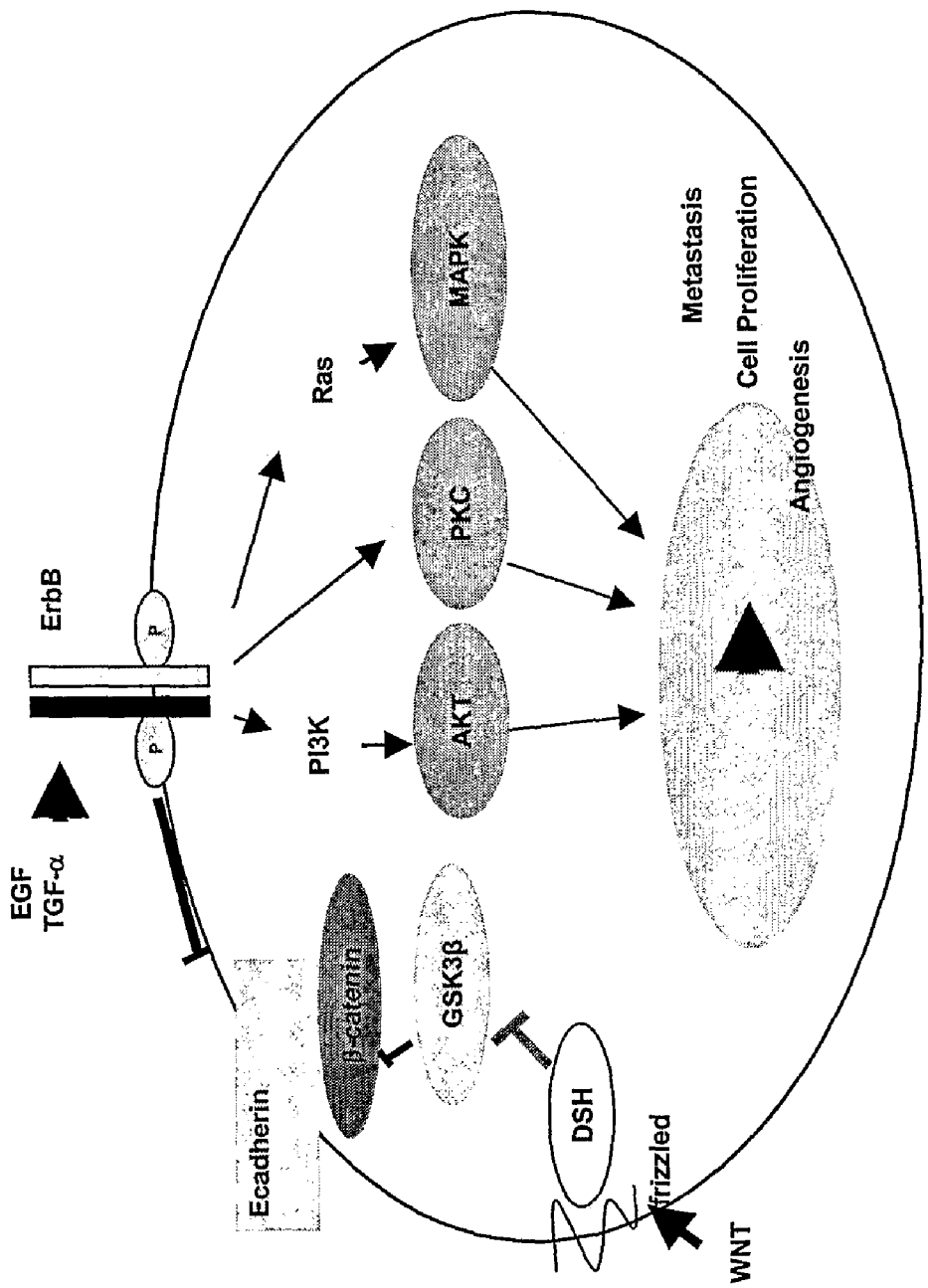
FIG. 1 is a schematic diagram showing the activation of signaling cascades from EGFR.

The present invention generally relates to the identification, provision and use of a panel of biomarkers that predict sensitivity or resistance to gefitinib and other EGFR inhibitors, and products and processes related thereto. Specifically, the present inventors have used NSCLC cell lines with varying sensitivity to the EGFR inhibitor, gefitinib, to define the novel panel of biomarkers as described herein. In order to identify a marker panel that could be used for selection of NSCLC patients who will respond to gefitinib treatment, the inventors undertook preclinical in vitro studies using NSCLC cell lines. Based on the therapeutic response to gefitinib by using the $IC_{50}$ definition (i.e., the concentration of agent needed to kill 50% of the tumor cells in a cell culture), the present inventors have classified the cell lines as sensitive ($IC_{50}<1$ μM), resistant ($IC_{50}>10$ μM), or having intermediate sensitivity (1 μM$<IC_{50}<10$ μM) to gefitinib. The cell lines were characterized by gene microarray analysis (Affymetrix™ microarray Human Genome U133 set, 39,000 genes). By comparing the gene microarray results from sensitive and resistant cell lines, the inventors have identified a panel of genes that can discriminate between sensitive and resistant cell lines. These biomarkers (i.e., the genes identified) will be of great clinical significance in selecting NSCLC patients/human tumors which will respond to this agent. The biomarkers identified by the present invention, and their expression levels in gefitinib sensitive and resistant cells, are listed in Table 1, and the nucleotide sequences representing such biomarkers are represented herein by SEQ ID NOs:1-194.

The nucleic acid sequences represented by SEQ ID NOs:1-194 include transcripts or nucleotides derived therefrom (e.g., cDNA) expressed by the gene biomarkers in Table 1. It is to be understood that the present invention expressly covers additional genes that can be elucidated using substantially the same techniques used to identify the genes in Table 1 and that any of such additional genes can be used in the methods and products described herein for the genes and probe sets in Table 1. Any reference to database Accession numbers or other information regarding the genes and probe sets in Table 1 is hereby incorporated by reference in its entirety. For each biomarker listed in Table 1, the following information is provided: (1) the probe set ID number given by Affymetrix™ for the set of features on the array representing the indicated gene; (2) the parametric p-value, indicating the statistical significance of that individual gene expression difference; (3) the mean intensity of expression of each gene in a gefitinib-sensitive and a gefitinib-resistant cell line; (4) the HUGO-approved symbol for the gene, where one exists; (5) the sequence identifier representing a nucleotide sequence found in or transcribed by the gene; and (6) the name or title of the gene, where one is given. It is noted that sometimes two probe sets in Table 1 will refer to a single gene, and these duplications have been maintained because they are believed to reflect different splice variants of that gene. In such a case, the associated sequence files will reflect the different splicotypes for that gene. The genes in Table 1 have been sorted by their parametric p-value to indicate the genes that are most highly regulated by gefitinib first.

In addition, the present invention will also be useful for the validation in other studies of the clinical significance of many of the specific biomarkers described herein, as well as the identification of preferred biomarker profiles, highly sensitive biomarkers, and targets for the design of novel therapeutic products and strategies. The biomarkers described herein are particularly useful in clinical practice to select the patients who will benefit most from EGFR inhibitor treatment and in specific embodiments, from gefitinib treatment.

The present inventors have already used the biomarkers described herein to identify specific targets for the further development of diagnostic and therapeutic approaches used in cancer, and these studies are described in detail in the Examples. For example, E-cadherin is a calcium-dependent epithelial cell adhesion molecule that plays an important role in tumor invasiveness and metastatic potential. Reduced E-cadherin expression is associated with tumor cell dedifferentiation, advanced stage and reduced survival in patients with NSCLC. Using Western blot analysis, E-cadherin was expressed in three cell lines highly sensitive to gefitinib and its expression was lacking in six gefitinib resistant cell lines tested. Real-time RT-PCR was used to evaluate the gene expression pattern in 11 NSCLC cell lines and compared to gene expression in normal bronchial epithelium. E-cadherin expression was elevated in cell lines sensitive to gefitinib and downregulated in the resistant cell lines as compared to the normal bronchial epithelium. The expression of E-cadherin is regulated by zinc finger inhibitory proteins by the recruitment of histone deacetylases (HDAC). Using real-time RT-PCR, the expression of the two zinc-finger transcription factors, δEF1/ZEB1 and SIP1/ZEB2, involved in E-cadherin repression was evaluated. Results showed that ZEB1 was expressed in gefitinib resistant cell lines and its expression was lacking in gefitinib sensitive cell lines. The present inventors have also found that δEF1/ZEB1 and SIP1/ZEB2 may regulate Her3, which is an EGFR heterodimer. These data indicate that the expression of ZEB1 may predict resistance to EGFR tyrosine kinase inhibitors and future studies directed at modulating the regulation of E-cadherin expression are expected to enhance the activity of EGFR inhibitors in NSCLC.

Finally, the present invention also relates to protein profiles which can discriminate between sensitive and resistant NSCLC tumors.

Prior to the present invention, to the best of the present inventors' knowledge, no single marker, or marker panel, has been demonstrated to be useful for selection of lung cancer patients who will benefit from EGFR inhibitors, and particularly, gefitinib, treatment. Nor are there any such markers (related to EGFR inhibitors) identified for other types of cancer.

Accordingly, using the gene expression profiles disclosed in Table 1 for gefitinib-sensitive and -resistant cells, one can rapidly, effectively and efficiently screen patients/human tumors for a level of sensitivity or resistance to gefitinib and also to other EGFR inhibitors having biological activity substantially similar to gefitinib (i.e., drugs having similar activities, gefitinib agonists and other derivatives). The results will allow for the identification of tumors/patients that are likely to benefit from administration of the drug and therefore, the genes are used to enhance the ability of the clinician to develop prognosis and treatment protocols for the individual patient. In addition, genes identified in Table 1 can be further validated as targets and then used in assays to identify therapeutic reagents useful for regulating the expression or activity of the target in a manner that improves sensitivity of a cell to gefitinib or analogs thereof. The knowledge provided from the expression profile of genes described herein and the identification additional genes using similar methods can also be used to identify the molecular mechanisms of EGFR inhibition, such knowledge being useful for the further development of new therapies and even analogs of gefitinib or other EGFR inhibitors with improved efficacies in cancer treatment. Moreover, given the knowledge of these genes, one can produce novel combinations of polynucleotides and/or antibodies and/or peptides for use in the various assays, diagnostic and/or therapeutic approaches described herein.

Finally, the present invention is also illustrative of methods by which patients can be evaluated for predicted sensitivity or resistance to EGFR inhibitors other than gefitinib, and of methods of identifying additional genes and gene panels that are regulated differentially by cells that are sensitive to or resistant to gefitinib or other EGFR inhibitors. Such genes and panels of genes can then be used in the assays and methods described herein and as targets useful for the development of novel EGFR inhibitors and therapeutic formulations.

Various definitions and aspects of the invention will be described below, but the invention is not limited to any specific embodiments that may be used for illustrative or exemplary purposes.

According to the present invention, in general, the biological activity or biological action of a protein refers to any function(s) exhibited or performed by the protein that is ascribed to the naturally occurring form of the protein as measured or observed in vivo (i.e., in the natural physiological environment of the protein) or in vitro (i.e., under laboratory conditions). Modifications of a protein, such as in a homologue or mimetic (discussed below), may result in proteins having the same biological activity as the naturally occurring protein, or in proteins having decreased or increased biological activity as compared to the naturally occurring protein. Modifications which result in a decrease in protein expression or a decrease in the activity of the protein, can be referred to as inactivation (complete or partial), down-regulation, or decreased action of a protein. Similarly, modifications which result in an increase in protein expression or an increase in the activity of the protein, can be referred to as amplification, overproduction, activation, enhancement, up-regulation or increased action of a protein.

According to the present invention, a "downstream gene" or "endpoint gene" is any gene, the expression of which is regulated (up or down) within a gefitinib sensitive or resistant cell. Selected sets of one, two, and preferably several or many of the genes (up to the number equivalent to all of the genes) of this invention can be used as end-points for rapid screening of patient cells for sensitivity or resistance to EGFR inhibitors such as gefitinib and for the other methods as described herein, including the identification of novel targets for the development of new cancer therapeutics.

As used herein, the term "homologue" is used to refer to a protein or peptide which differs from a naturally occurring protein or peptide (i.e., the "prototype" or "wild-type" protein) by minor modifications to the naturally occurring protein or peptide, but which maintains the basic protein and side chain structure of the naturally occurring form. Such changes include, but are not limited to: changes in one or a few amino acid side chains; changes one or a few amino acids, including deletions (e.g., a truncated version of the protein or peptide) insertions and/or substitutions; changes in stereochemistry of one or a few atoms; and/or minor derivatizations, including but not limited to: methylation, glycosylation, phosphorylation, acetylation, myristoylation, prenylation, palmitation, amidation and/or addition of glycosylphosphatidyl inositol. A homologue can have either enhanced, decreased, or substantially similar properties as compared to the naturally occurring protein or peptide. A homologue can include an agonist of a protein or an antagonist of a protein.

Homologues can be the result of natural allelic variation or natural mutation. A naturally occurring allelic variant of a nucleic acid encoding a protein is a gene that occurs at essentially the same locus (or loci) in the genome as the gene which encodes such protein, but which, due to natural variations caused by, for example, mutation or recombination, has a similar but not identical sequence. Allelic variants typically encode proteins having similar activity to that of the protein encoded by the gene to which they are being compared. One class of allelic variants can encode the same protein but have different nucleic acid sequences due to the degeneracy of the genetic code. Allelic variants can also comprise alterations in the 5' or 3' untranslated regions of the gene (e.g., in regulatory control regions). Allelic variants are well known to those skilled in the art.

An agonist can be any compound which is capable of mimicking, duplicating or approximating the biological activity of a naturally occurring or specified protein, for example, by associating with (e.g., binding to) or activating a protein (e.g., a receptor) to which the natural protein binds, so that activity that would be produced with the natural protein is stimulated, induced, increased, or enhanced. For example, an agonist can include, but is not limited to, a protein, compound, or an antibody that selectively binds to and activates or increases the activation of a receptor bound by the natural protein, other homologues of the natural protein, and any suitable product of drug design that is characterized by its ability to agonize (e.g., stimulate, induce, increase, enhance) the biological activity of a naturally occurring protein.

An antagonist refers to any compound or agent which is capable of acting in a manner that is antagonistic to (e.g., against, a reversal of, contrary to) the action of the natural agonist, for example by interacting with another protein or molecule in a manner that the biological activity of the naturally occurring protein or agonist is decreased (e.g., reduced, inhibited, blocked). Such a compound can include, but is not limited to, an antibody that selectively binds to and blocks access to a protein by its natural ligand, or reduces or inhibits the activity of a protein, a product of drug design that blocks the protein or reduces the biological activity of the protein, an anti-sense nucleic acid molecule that binds to a nucleic acid molecule encoding the protein and prevents expression of the protein, a ribozyme that binds to the RNA and prevents expression of the protein, RNAi, an aptamer, and a soluble protein, which competes with a natural receptor or ligand.

Agonists and antagonists that are products of drug design can be produced using various methods known in the art. Various methods of drug design, useful to design mimetics or other compounds useful in the present invention are disclosed in Maulik et al., 1997, *Molecular Biotechnology: Therapeutic Applications and Strategies*, Wiley-Liss, Inc., which is incorporated herein by reference in its entirety. An agonist or antagonist can be obtained, for example, from molecular diversity strategies (a combination of related strategies allowing the rapid construction of large, chemically diverse molecule libraries), libraries of natural or synthetic compounds, in particular from chemical or combinatorial libraries (i.e., libraries of compounds that differ in sequence or size but that have the similar building blocks) or by rational, directed or random drug design. See for example, Maulik et al., supra.

In a molecular diversity strategy, large compound libraries are synthesized, for example, from peptides, oligonucleotides, natural or synthetic steroidal compounds, carbohydrates and/or natural or synthetic organic and non-steroidal molecules, using biological, enzymatic and/or chemical approaches. The critical parameters in developing a molecular diversity strategy include subunit diversity, molecular size, and library diversity. The general goal of screening such libraries is to utilize sequential application of combinatorial selection to obtain high-affinity ligands for a desired target, and then to optimize the lead molecules by either random or directed design strategies. Methods of molecular diversity are described in detail in Maulik, et al., ibid.

As used herein, the term "mimetic" is used to refer to any natural or synthetic compound, peptide, oligonucleotide, carbohydrate and/or natural or synthetic organic molecule that is able to mimic the biological action of a naturally occurring or known synthetic compound.

As used herein, the term "putative regulatory compound" or "putative regulatory ligand" refers to compounds having an unknown regulatory activity, at least with respect to the ability of such compounds to regulate the expression or biological activity of a gene or protein encoded thereby, or to regulate sensitivity or resistance to an EGFR inhibitor as encompassed by the present invention.

In accordance with the present invention, an isolated polynucleotide, which phrase can be used interchangeably with "an isolated nucleic acid molecule", is a nucleic acid molecule that has been removed from its natural milieu (i.e., that has been subject to human manipulation), its natural milieu being the genome or chromosome in which the nucleic acid molecule is found in nature. As such, "isolated" does not necessarily reflect the extent to which the nucleic acid molecule has been purified, but indicates that the molecule does not include an entire genome or an entire chromosome in which the nucleic acid molecule is found in nature. Polynucleotides useful in the plurality of polynucleotides of the present invention (described below) are typically a portion of a gene or transcript thereof of the present invention that is suitable for use, for example, as a hybridization probe or PCR primer for the identification of a full-length gene, a transcript thereof, or a polynucleotide derived from the gene or transcript (e.g., cDNA), in a given sample (e.g., a cell sample). An isolated nucleic acid molecule can include a gene or a portion of a gene (e.g., the regulatory region or promoter), for example, to produce a reporter construct according to the present invention. An isolated nucleic acid molecule that includes a gene is not a fragment of a chromosome that includes such gene, but rather includes the coding region and regulatory regions associated with the gene, but no additional genes naturally found on the same chromosome. An isolated nucleic acid molecule can also include a specified nucleic acid sequence flanked by (i.e., at the 5' and/or the 3' end of the sequence) additional nucleic acids that do not normally flank the specified nucleic acid sequence in nature (i.e., heterologous sequences). Isolated nucleic acid molecules can include DNA, RNA (e.g., mRNA), or derivatives of either DNA or RNA (e.g., cDNA). Although the phrase "nucleic acid molecule" or "polynucleotide" primarily refers to the physical nucleic acid molecule and the phrase "nucleic acid sequence" primarily refers to the sequence of nucleotides on the nucleic acid molecule, the two phrases can be used interchangeably, especially with respect to a nucleic acid molecule, or a nucleic acid sequence, being capable of encoding a protein.

Preferably, an isolated nucleic acid molecule of the present invention is produced using recombinant DNA technology (e.g., polymerase chain reaction (PCR) amplification, cloning) or chemical synthesis. Isolated nucleic acid molecules include natural nucleic acid molecules and homologues thereof, including, but not limited to, natural allelic variants and modified nucleic acid molecules in which nucleotides have been inserted, deleted, substituted, and/or inverted in such a manner that such modifications provide the desired effect on the biological activity of the protein as described herein. Protein homologues (e.g., proteins encoded by nucleic acid homologues) have been discussed in detail above.

The minimum size of a nucleic acid molecule or polynucleotide of the present invention is a size sufficient to encode a protein having a desired biological activity, sufficient to form a probe or oligonucleotide primer that is capable of forming a stable hybrid with the complementary sequence of a nucleic acid molecule encoding the natural protein (e.g., under moderate, high or very high stringency conditions), or to otherwise be used as a target in an assay or in any therapeutic method discussed herein. If the polynucleotide is an oligonucleotide probe or primer, the size of the polynucleotide can be dependent on nucleic acid composition and percent homology or identity between the nucleic acid molecule and a complementary sequence as well as upon hybridization conditions per se (e.g., temperature, salt concentration, and formamide concentration). The minimum size of a polynucleotide that is used as an oligonucleotide probe or primer is at least about 5 nucleotides in length, and preferably ranges from about 5 to about 50 or about 500 nucleotides, including any length in between, in whole number increments (i.e., 5, 6, 7, 8, 9, 10, . . . 33, 34, . . . 256, 257, . . . 500), and more preferably from about 10 to about 40 nucleotides, and most preferably from about 15 to about 40 nucleotides in length. In one aspect, the oligonucleotide primer or probe is typically at least about 12 to about 15 nucleotides in length if the nucleic acid molecules are GC-rich and at least about 15 to about 18 bases in length if they are AT-rich. There is no limit, other than a practical limit, on the maximal size of a nucleic acid molecule of the present invention, in that the nucleic acid molecule can include a portion of a protein-encoding sequence or a nucleic acid sequence encoding a full-length protein.

An isolated protein, according to the present invention, is a protein (including a peptide) that has been removed from its natural milieu (i.e., that has been subject to human manipulation) and can include purified proteins, partially purified proteins, recombinantly produced proteins, and synthetically produced proteins, for example. As such, "isolated" does not reflect the extent to which the protein has been purified. An isolated protein useful as an antagonist or agonist according to the present invention can be isolated from its natural source, produced recombinantly or produced synthetically. Smaller peptides useful as regulatory peptides are typically produced synthetically by methods well known to those of skill in the art.

According to the present invention, the phrase "selectively binds to" refers to the ability of an antibody, antigen binding fragment or binding partner (antigen binding peptide) to preferentially bind to specified proteins. More specifically, the phrase "selectively binds" refers to the specific binding of one protein to another (e.g., an antibody, fragment thereof, or binding partner to an antigen), wherein the level of binding, as measured by any standard assay (e.g., an immunoassay), is statistically significantly higher than the background control for the assay. For example, when performing an immunoassay, controls typically include a reaction well/tube that contain antibody or antigen binding fragment alone (i.e., in the absence of antigen), wherein an amount of reactivity (e.g., non-specific binding to the well) by the antibody or antigen binding fragment thereof in the absence of the antigen is considered to be background. Binding can be measured using a variety of methods standard in the art including enzyme immunoassays (e.g., ELISA), immunoblot assays, etc.).

In some embodiments of the present invention, a compound is contacted with one or more nucleic acids or proteins. Such methods can include cell-based assays, or non-cell-based assay. In one embodiment, a target gene is expressed by a cell (i.e., a cell-based assay). In one embodiment, the conditions under which a cell expressing a target is contacted with a putative regulatory compound, such as by mixing, are conditions in which the expression or biological activity of the target (gene or protein encoded thereby) is not stimulated (activated) if essentially no regulatory compound is present. For example, such conditions include normal culture conditions in the absence of a known activating compound or other equivalent stimulus. The putative regulatory compound is then contacted with the cell. In this embodiment, the step of detecting is designed to indicate whether the putative regulatory compound alters the expression and/or biological activity of the gene or protein target as compared to in the absence of the putative regulatory compound (i.e., the background level).

In accordance with the present invention, a cell-based assay as described herein is conducted under conditions which are effective to screen for regulatory compounds or to profile gene expression as described in the methods of the present invention. Effective conditions include, but are not limited to, appropriate media, temperature, pH and oxygen conditions that permit the growth of the cell that expresses the receptor. An appropriate, or effective, medium is typically a solid or liquid medium comprising growth factors and assimilable carbon, nitrogen and phosphate sources, as well as appropriate salts, minerals, metals and other nutrients, such as vitamins. Culturing is carried out at a temperature, pH and oxygen content appropriate for the cell. Such culturing conditions are within the expertise of one of ordinary skill in the art.

Cells that are useful in the cell-based assays of the present invention include any cell that expresses a gene that is to be investigated as a target, or in the diagnostic assays described herein, any cell that is isolated from a patient, including normal or malignant (tumor) cells.

According to the present invention, the method includes the step of detecting the expression of at least one, and preferably more than one, and most preferably, several, of the genes that are regulated differently in EGFR inhibitor-sensitive versus EGFR inhibitor-resistant cells, and particularly, of the genes that have now been shown to be regulated differently in gefitinib-sensitive versus gefitinib-resistant cells, by the present inventors. As used herein, the term "expression", when used in connection with detecting the expression of a gene, can refer to detecting transcription of the gene and/or to detecting translation of the gene. To detect expression of a gene refers to the act of actively determining whether a gene is expressed or not. This can include determining whether the gene expression is upregulated as compared to a control, downregulated as compared to a control, or unchanged as compared to a control. Therefore, the step of detecting expression does not require that expression of the gene actually is upregulated or downregulated, but rather, can also include detecting that the expression of the gene has not changed (i.e., detecting no expression of the gene or no change in expression of the gene).

The present method includes the step of detecting the expression of at least one gene set forth in Table 1. In a preferred embodiment, the step of detecting includes detecting the expression of at least 2 genes, and preferably at least 3 genes, and more preferably at least 4 genes, and more preferably at least 5 genes, and more preferably at least 6 genes, and more preferably at least 7 genes, and more preferably at least 8 genes, and more preferably at least 9 genes, and more preferably at least 10 genes, and more preferably at least 11 genes, and more preferably at least 12 genes, and more preferably at least 13 genes, and more preferably at least 14 genes, and more preferably at least 15 genes, and so on, in increments of one (i.e., 1, 2, 3, . . . 12, 13, . . . 56, 57, . . . 78, 79 . . . ), up to detecting expression of all of the genes disclosed herein in Table 1. For example, in one aspect of the invention, the expression of at least five genes is detected, and in another aspect, the expression of at least 10 genes is detected, and in another aspect, the expression of at least 25 genes is detected, and in another aspect, the expression of at least 50 genes is detected, and in another aspect, the expression of at least 100 genes is detected, and in another aspect, the expression of at least 150 genes is detected. Preferably, larger numbers of genes in Table 1 are detected, as this will increase the sensitivity of the detection method. Analysis of a number of genes greater than 1 can be accomplished simultaneously, sequentially, or cumulatively.

In another embodiment of the invention, detecting in the sample the expression of one or more genes chosen from a panel of genes whose expression has been correlated with sensitivity or resistance to an EGFR inhibitor. For example, such genes can be identified using the methods for identifying the genes whose expression is correlated with gefitinib-resistance or sensitivity as described herein. In one aspect, the panel of genes is identified by a method comprising: (a) providing a sample of cells that are sensitive or resistant to treatment with the EGFR inhibitor; (b) detecting the expression of at least one gene in the EGFR inhibitor-sensitive cells as compared to the level of expression of the gene or genes in the EGFR inhibitor-resistant cells; and (c) identifying a gene or genes having a level of expression in EGFR inhibitor-sensitive cells that is statistically significantly different than the level of expression of the gene or genes in EGFR inhibitor-resistant cells, as potentially being a molecule that interacts with the EGFR pathway to allow or enhance responsiveness to EGFR inhibitors. The present invention is not intended to be limited solely to the biomarkers listed in Table 1. Rather, the biomarkers of Table 1 illustrate various aspects of the invention that can now be achieved given the discoveries by the inventors. Therefore, although many of the embodiments below are discussed in terms gefitinib, it is to be understood that the methods of the invention can be extended to other EGFR inhibitors, and particularly to those that are similar in structure and/or function to gefitinib, including agonists of gefitinib.

The first steps of the method to select a cancer patient that is predicted to benefit from therapeutic administration of an EGFR inhibitor, an agonist thereof, or a drug having substantially similar biological activity as EGFR inhibitor of the present invention, includes providing a patient sample (also called a test sample) and detecting in the sample the expression of a gene or genes. Suitable methods of obtaining a patient sample are known to a person of skill in the art. A patient sample can include any bodily fluid or tissue from a patient that may contain tumor cells or proteins of tumor cells. More specifically, according to the present invention, the term "test sample" or "patient sample" can be used generally to refer to a sample of any type which contains cells or products that have been secreted from cells to be evaluated by the present method, including but not limited to, a sample of isolated cells, a tissue sample and/or a bodily fluid sample. According to the present invention, a sample of isolated cells is a specimen of cells, typically in suspension or separated from connective tissue which may have connected the cells within a tissue in vivo, which have been collected from an organ, tissue or fluid by any suitable method which results in the collection of a suitable number of cells for evaluation by the method of the present invention. The cells in the cell sample are not necessarily of the same type, although purification methods can be used to enrich for the type of cells that are preferably evaluated. Cells can be obtained, for example, by scraping of a tissue, processing of a tissue sample to release individual cells, or isolation from a bodily fluid.

A tissue sample, although similar to a sample of isolated cells, is defined herein as a section of an organ or tissue of the body which typically includes several cell types and/or cytoskeletal structure which holds the cells together. One of skill in the art will appreciate that the term "tissue sample" may be used, in some instances, interchangeably with a "cell sample", although it is preferably used to designate a more complex structure than a cell sample. A tissue sample can be obtained by a biopsy, for example, including by cutting, slicing, or a punch. A bodily fluid sample, like the tissue sample, contains the cells to be evaluated for marker expression or biological activity and/or may contain a soluble biomarker that is secreted by cells, and is a fluid obtained by any method suitable for the particular bodily fluid to be sampled. Bodily fluids suitable for sampling include, but are not limited to, blood, mucous, seminal fluid, saliva, breast milk, bile and urine.

In general, the sample type (i.e., cell, tissue or bodily fluid) is selected based on the accessibility and structure of the organ or tissue to be evaluated for tumor cell growth and/or on what type of cancer is to be evaluated. For example, if the organ/tissue to be evaluated is the breast, the sample can be a sample of epithelial cells from a biopsy (i.e., a cell sample) or a breast tissue sample from a biopsy (a tissue sample). The sample that is most useful in the present invention will be cells, tissues or bodily fluids isolated from a patient by a biopsy or surgery or routine laboratory fluid collection.

Once a sample is obtained from the patient, the sample is evaluated for the detection of the expression of the gene or genes that have been correlated with sensitivity or resistance to an EGFR inhibitor (e.g., gefitinib) of the present invention.

For example, as discussed above, any one or more of the genes in Table 1 comprising or expressing a transcript comprising one of SEQ ID NOs:1-194 are useful for detection in the present method.

In one aspect, it may be desirable to select those genes for detection that are particularly highly regulated in gefitinib-sensitive cells versus gefitinib-resistant cells in that they display the largest increases or decreases in expression levels. The detection of such genes can be advantageous because the endpoint may be more clear and require less quantitation. The relative expression levels of the genes identified in the present invention are listed in Table 1, and the genes are ranked in the Table. Therefore, one can easily select subsets of particularly highly regulated genes, or subsets of genes based on some other desired characteristic to provide a more robust, sensitive, or selective assay. In one embodiment, one of skill in the art might choose to detect genes that exhibited a fold increase above background of at least 2. In another embodiment, one of skill in the art might choose to detect genes that exhibited a fold increase or decrease above background of at least 3, and in another embodiment at least 4, and in another embodiment at least 5, and in another embodiment at least 6, and in another embodiment at least 7, and in another embodiment at least 8, and in another embodiment at least 9, and in another embodiment at least 10 or higher fold changes. It is noted that fold increases or decreases are not typically compared from one gene to another, but with reference to the background level for that particular gene.

In one aspect of the method of the present invention, the step of detecting can include the detection of expression of one or more of the genes of this invention. Expression of transcripts and/or proteins is measured by any of a variety of known methods in the art. For RNA expression, methods include but are not limited to: extraction of cellular mRNA and Northern blotting using labeled probes that hybridize to transcripts encoding all or part of one or more of the genes of this invention; amplification of mRNA expressed from one or more of the genes of this invention using gene-specific primers, polymerase chain reaction (PCR), and reverse transcriptase-polymerase chain reaction (RT-PCR), followed by quantitative detection of the product by any of a variety of means; extraction of total RNA from the cells, which is then labeled and used to probe cDNAs or oligonucleotides encoding all or part of the genes of this invention, arrayed on any of a variety of surfaces; in situ hybridization; and detection of a reporter gene.

Methods to measure protein expression levels generally include, but are not limited to: Western blot, immunoblot, enzyme-linked immunosorbant assay (ELISA), radioimmunoassay (RIA), immunoprecipitation, surface plasmon resonance, chemiluminescence, fluorescent polarization, phosphorescence, immunohistochemical analysis, matrix-assisted laser desorption/ionization time-of-flight (MALDI-TOF) mass spectrometry, microcytometry, microarray, microscopy, fluorescence activated cell sorting (FACS), and flow cytometry, as well as assays based on a property of the protein including but not limited to enzymatic activity or interaction with other protein partners. Binding assays are also well known in the art. For example, a BIAcore machine can be used to determine the binding constant of a complex between two proteins. The dissociation constant for the complex can be determined by monitoring changes in the refractive index with respect to time as buffer is passed over the chip (O'Shannessy et al. *Anal. Biochen.* 212:457 (1993); Schuster et al., *Nature* 365:343 (1993)). Other suitable assays for measuring the binding of one protein to another include, for example, immunoassays such as enzyme linked immunoabsorbent assays (ELISA) and radioimmunoassays (RIA); or determination of binding by monitoring the change in the spectroscopic or optical properties of the proteins through fluorescence, UV absorption, circular dichroism, or nuclear magnetic resonance (NMR).

Nucleic acid arrays are particularly useful for detecting the expression of the genes of the present invention. The production and application of high-density arrays in gene expression monitoring have been disclosed previously in, for example, WO 97/10365; WO 92/10588; U.S. Pat. No. 6,040,138; U.S. Pat. No. 5,445,934; or WO95/35505, all of which are incorporated herein by reference in their entireties. Also for examples of arrays, see Hacia et al. (1996) *Nature Genetics* 14:441-447; Lockhart et al. (1996) *Nature Biotechnol.* 14:1675-1680; and De Risi et al. (1996) *Nature Genetics* 14:457-460. In general, in an array, an oligonucleotide, a cDNA, or genomic DNA, that is a portion of a known gene occupies a known location on a substrate. A nucleic acid target sample is hybridized with an array of such oligonucleotides and then the amount of target nucleic acids hybridized to each probe in the array is quantified. One preferred quantifying method is to use confocal microscope and fluorescent labels. The Affymetrix GeneChip™ Array system (Affymetrix, Santa Clara, Calif.) and the Atlas™ Human cDNA Expression Array system are particularly suitable for quantifying the hybridization; however, it will be apparent to those of skill in the art that any similar systems or other effectively equivalent detection methods can also be used. In a particularly preferred embodiment, one can use the knowledge of the genes described herein to design novel arrays of polynucleotides, cDNAs or genomic DNAs for screening methods described herein. Such novel pluralities of polynucleotides are contemplated to be a part of the present invention and are described in detail below.

Suitable nucleic acid samples for screening on an array contain transcripts of interest or nucleic acids derived from the transcripts of interest. As used herein, a nucleic acid derived from a transcript refers to a nucleic acid for whose synthesis the mRNA transcript or a subsequence thereof has ultimately served as a template. Thus, a cDNA reverse transcribed from a transcript, an RNA transcribed from that cDNA, a DNA amplified from the cDNA, an RNA transcribed from the amplified DNA, etc., are all derived from the transcript and detection of such derived products is indicative of the presence and/or abundance of the original transcript in a sample. Thus, suitable samples include, but are not limited to, transcripts of the gene or genes, cDNA reverse transcribed from the transcript, cRNA transcribed from the cDNA, DNA amplified from the genes, RNA transcribed from amplified DNA, and the like. Preferably, the nucleic acids for screening are obtained from a homogenate of cells or tissues or other biological samples. Preferably, such sample is a total RNA preparation of a biological sample. More preferably in some embodiments, such a nucleic acid sample is the total mRNA isolated from a biological sample. Biological samples may be of any biological tissue or fluid or cells from any organism. Frequently the sample will be a "clinical sample" which is a sample derived from a patient, such as a lung tumor sample from a patient. Typical clinical samples include, but are not limited to, sputum, blood, blood cells (e.g., white cells), tissue or fine needle biopsy samples, urine, peritoneal fluid, and pleural fluid, or cells therefrom. Biological samples may also include sections of tissues, such as frozen sections or formalin fixed sections taken for histological purposes.

In one embodiment, it is desirable to amplify the nucleic acid sample prior to hybridization. One of skill in the art will appreciate that whatever amplification method is used, if a quantitative result is desired, care must be taken to use a method that maintains or controls for the relative frequencies of the amplified nucleic acids to achieve quantitative amplification. Methods of "quantitative" amplification are well known to those of skill in the art. For example, quantitative PCR involves simultaneously co-amplifying a known quantity of a control sequence using the same primers. This provides an internal standard that may be used to calibrate the PCR reaction. The high-density array may then include probes specific to the internal standard for quantification of the amplified nucleic acid. Other suitable amplification methods include, but are not limited to polymerase chain reaction (PCR) Innis, et al., PCR Protocols. A guide to Methods and Application. Academic Press, Inc. San Diego, (1990)), ligase chain reaction (LCR) (see Wu and Wallace, Genomics, 4: 560 (1989), Landegren, et al., Science, 241: 1077 (1988) and Barringer, et al., Gene, 89: 117 (1990), transcription amplification (Kwoh, et al., Proc. Natl. Acad. Sci. USA, 86: 1173 (1989)), and self-sustained sequence replication (Guatelli, et al, Proc. Nat. Acad. Sci. USA, 87: 1874 (1990)).

Nucleic acid hybridization simply involves contacting a probe and target nucleic acid under conditions where the probe and its complementary target can form stable hybrid duplexes through complementary base pairing. As used herein, hybridization conditions refer to standard hybridization conditions under which nucleic acid molecules are used to identify similar nucleic acid molecules. Such standard conditions are disclosed, for example, in Sambrook et al., *Molecular Cloning: A Laboratory Manual*, Cold Spring Harbor Labs Press, 1989. Sambrook et al., ibid., is incorporated by reference herein in its entirety (see specifically, pages 9.31-9.62). In addition, formulae to calculate the appropriate hybridization and wash conditions to achieve hybridization permitting varying degrees of mismatch of nucleotides are disclosed, for example, in Meinkoth et al., 1984, *Anal. Biochem.* 138, 267-284; Meinkoth et al., ibid., is incorporated by reference herein in its entirety. Nucleic acids that do not form hybrid duplexes are washed away from the hybridized nucleic acids and the hybridized nucleic acids can then be detected, typically through detection of an attached detectable label. It is generally recognized that nucleic acids are denatured by increasing the temperature or decreasing the salt concentration of the buffer containing the nucleic acids. Under low stringency conditions (e.g., low temperature and/or high salt) hybrid duplexes (e.g., DNA:DNA, RNA:RNA, or RNA:DNA) will form even where the annealed sequences are not perfectly complementary. Thus specificity of hybridization is reduced at lower stringency. Conversely, at higher stringency (e.g., higher temperature or lower salt) successful hybridization requires fewer mismatches.

High stringency hybridization and washing conditions, as referred to herein, refer to conditions which permit isolation of nucleic acid molecules having at least about 90% nucleic acid sequence identity with the nucleic acid molecule being used to probe in the hybridization reaction (i.e., conditions permitting about 10% or less mismatch of nucleotides). One of skill in the art can use the formulae in Meinkoth et al., 1984, *Anal. Biochem.* 138, 267-284 (incorporated herein by reference in its entirety) to calculate the appropriate hybridization and wash conditions to achieve these particular levels of nucleotide mismatch. Such conditions will vary, depending on whether DNA:RNA or DNA:DNA hybrids are being formed. Calculated melting temperatures for DNA:DNA hybrids are 10° C. less than for DNA:RNA hybrids. In particular embodiments, stringent hybridization conditions for DNA:DNA hybrids include hybridization at an ionic strength of 6×SSC (0.9 M Na$^+$) at a temperature of between about 20°

C. and about 35° C., more preferably, between about 28° C. and about 40° C., and even more preferably, between about 35° C. and about 45° C. In particular embodiments, stringent hybridization conditions for DNA:RNA hybrids include hybridization at an ionic strength of 6×SSC (0.9 M Na⁺) at a temperature of between about 30° C. and about 45° C., more preferably, between about 38° C. and about 50° C., and even more preferably, between about 45° C. and about 55° C. These values are based on calculations of a melting temperature for molecules larger than about 100 nucleotides, 0% formamide and a G+C content of about 40%. Alternatively, $T_m$ can be calculated empirically as set forth in Sambrook et al., supra, pages 9.31 to 9.62.

The hybridized nucleic acids are detected by detecting one or more labels attached to the sample nucleic acids. The labels may be incorporated by any of a number of means well known to those of skill in the art. Detectable labels suitable for use in the present invention include any composition detectable by spectroscopic, photochemical, biochemical, immunochemical, electrical, optical or chemical means. Useful labels in the present invention include biotin for staining with labeled streptavidin conjugate, magnetic beads (e.g., Dynabeads™), fluorescent dyes (e.g., fluorescein, texas red, rhodamine, green fluorescent protein, and the like), radiolabels (e.g., $^3$H, $^{125}$I, $^{35}$S, $^{14}$C, or $^{32}$P), enzymes (e.g., horse radish peroxidase, alkaline phosphatase and others commonly used in an ELISA), and colorimetric labels such as colloidal gold or colored glass or plastic (e.g., polystyrene, polypropylene, latex, etc.) beads. Means of detecting such labels are well known to those of skill in the art. Thus, for example, radiolabels may be detected using photographic film or scintillation counters, fluorescent markers may be detected using a photodetector to detect emitted light. Enzymatic labels are typically detected by providing the enzyme with a substrate and detecting the reaction product produced by the action of the enzyme on the substrate, and colorimetric labels are detected by simply visualizing the colored label.

The term "quantifying" or "quantitating" when used in the context of quantifying transcription levels of a gene can refer to absolute or to relative quantification. Absolute quantification may be accomplished by inclusion of known concentration(s) of one or more target nucleic acids and referencing the hybridization intensity of unknowns with the known target nucleic acids (e.g. through generation of a standard curve). Alternatively, relative quantification can be accomplished by comparison of hybridization signals between two or more genes, or between two or more treatments to quantify the changes in hybridization intensity and, by implication, transcription level.

In one aspect of the present method, in vitro cell based assays may be designed to screen for compounds that affect the regulation of genes at either the transcriptional or translational level. One, two or more promoters of the genes of this invention can be used to screen unknown compounds for activity on a given target. Promoters of the selected genes can be linked to any of several reporters (including but not limited to chloramphenicol acetyl transferase, or luciferase) that measure transcriptional read-out. The promoters can be tested as pure DNA, or as DNA bound to chromatin proteins.

In one aspect of the present method, the step of detecting can include the expression of one or more genes of the invention in intact animals or tissues obtained from such animals. Mammalian (i.e. mouse, rat, monkey) or non-mammalian (i.e. chicken) species can be the test animals. Sample tissues from a patient can also be screened. The tissues to be surveyed can be either normal or malignant tissues. The presence and quantity of endogenous mRNA or protein expression of one or more of the genes of this invention can be measured in those tissues. The gene markers can be measured in tissues that are fresh, frozen, fixed or otherwise preserved. They can be measured in cytoplasmic or nuclear organ-, tissue- or cell-extracts; or in cell membranes including but not limited to plasma, cytoplasmic, mitochondrial, golgi or nuclear membranes; in the nuclear matrix; or in cellular organelles and their extracts including but not limited to ribosomes, nuclei, nucleoli, mitochondria, or golgi. Assays for endogenous expression of mRNAs or proteins encoded by the genes of this invention can be performed as described above. Alternatively, intact transgenic animals can be generated for screening for research or validation purposes.

Preferably, a gene identified as being upregulated or downregulated in a test cell according to the invention (including a sample tumor cell to be screened) is regulated in the same direction and to at least about 5%, and more preferably at least about 10%, and more preferably at least 20%, and more preferably at least 25%, and more preferably at least 30%, and more preferably at least 35%, and more preferably at least 40%, and more preferably at least 45%, and more preferably at least 50%, and preferably at least 55%, and more preferably at least 60%, and more preferably at least 65%, and more preferably at least 70%, and more preferably at least 75%, and more preferably at least 80%, and more preferably at least 85%, and more preferably at least 90%, and more preferably at least 95%, and more preferably of 100%, or any percentage change between 5% and higher in 1% increments (i.e., 5%, 6%, 7%, 8% . . . ), of the level of expression of the gene that is seen in established or confirmed gefitinib-sensitive or gefitinib-resistant cells. A gene identified as being upregulated or downregulated in a test cell according to the invention can also be regulated in the same direction and to a higher level than the level of expression of the gene that is seen in established or confirmed gefitinib-sensitive or gefitinib-resistant cells.

The values obtained from the test and/or control samples are statistically processed using any suitable method of statistical analysis to establish a suitable baseline level using methods standard in the art for establishing such values. Statistical significance according to the present invention should be at least p<0.05.

It will be appreciated by those of skill in the art that differences between the expression of genes in sensitive versus resistant cells may be small or large. Some small differences may be very reproducible and therefore nonetheless useful. For other purposes, large differences may be desirable for ease of detection of the activity. It will be therefore appreciated that the exact boundary between what is called a positive result and a negative result can shift, depending on the goal of the screening assay and the genes to be screened. For some assays it may be useful to set threshold levels of change. One of skill in the art can readily determine the criteria for screening of cells given the information provided herein.

The presence and quantity of each gene marker can be measured in primary tumors, metastatic tumors, locally recurring tumors, ductal carcinomas in situ, or other tumors. The markers can be measured in solid tumors that are fresh, frozen, fixed or otherwise preserved. They can be measured in cytoplasmic or nuclear tumor extracts; or in tumor membranes including but not limited to plasma, mitochondrial, golgi or nuclear membranes; in the nuclear matrix; or in tumor cell organelles and their extracts including but not limited to ribosomes, nuclei, mitochondria, golgi.

The level of expression of the gene or genes detected in the test or patient sample f the invention is compared to a baseline or control level of expression of that gene. More specifically, according to the present invention, a "baseline level" is a control level of biomarker expression against which a test level of biomarker expression (i.e., in the test sample) can be compared. In the present invention, the control level of biomarker expression can be the expression level of the gene or genes in a control cell that is sensitive to the EGFR inhibitor, and/or the expression level of the gene or genes in a control cell that is resistant to the EGFR inhibitor. Other controls may also be included in the assay. In one embodiment, the control is established in an autologous control sample obtained from the patient. The autologous control sample can be a sample of isolated cells, a tissue sample or a bodily fluid sample, and is preferably a cell sample or tissue sample. According to the present invention, and as used in the art, the term "autologous" means that the sample is obtained from the same patient from which the sample to be evaluated is obtained. The control sample should be of or from the same cell type and preferably, the control sample is obtained from the same organ, tissue or bodily fluid as the sample to be evaluated, such that the control sample serves as the best possible baseline for the sample to be evaluated. In one embodiment, control expression levels of the gene or genes that has been correlated with sensitivity and/or resistance to the EGFR inhibitor has been predetermined, such as in Table 1. Such a form of stored information can include, for example, but is not limited to, a reference chart, listing or electronic file of gene expression levels and profiles for EGFR inhibitor sensitive and/or EGFR inhibitor resistant biomarker expression, or any other source of data regarding baseline biomarker expression that is useful in the method of the invention. Therefore, it can be determined, based on the control or baseline level of biomarker expression or biological activity, whether the expression level of a gene or genes in a patient sample is/are more statistically significantly similar to the baseline for EGFR resistance or EGFR sensitivity.

A profile of individual gene markers, including a matrix of two or more markers, can be generated by one or more of the methods described above. According to the present invention, a profile of the genes in a tissue sample refers to a reporting of the expression level of a given gene from Table 1, and includes a classification of the gene with regard to how the gene is regulated in gefitinib-sensitive versus gefitinib-resistant cells. The data can be reported as raw data, and/or statistically analyzed by any of a variety of methods, and/or combined with any other prognostic marker(s).

Another embodiment of the present invention relates to a plurality of polynucleotides for the detection of the expression of genes as described herein. The plurality of polynucleotides consists of polynucleotides that are complementary to RNA transcripts, or nucleotides derived therefrom, of genes listed in Table 1 or otherwise identified as being useful according to the present invention (e.g., other genes correlated with sensitivity or resistance to gefitinib or another EGFR inhibitor), and is therefore distinguished from previously known nucleic acid arrays and primer sets. The plurality of polynucleotides within the above-limitation includes at least two or more polynucleotides that are complementary to RNA transcripts, or nucleotides derived therefrom, of one or more genes identified by the present inventors and listed in Table 1. Preferably, the plurality of polynucleotides is capable of detecting expression of at least two, and more preferably at least five, and more preferably at least 10, and more preferably at least 25, and more preferably at least 50, and more preferably at least 100, and more preferably at least 150, and more preferably all of the genes (or any number in between two and all of the genes, in whole increments) in a panel of genes correlated with EGFR inhibitor sensitivity and/or resistance, such as all of the genes listed in Table 1.

In one embodiment, it is contemplated that additional genes that are not regulated differently in gefitinib-sensitive versus gefitinib-resistant cells can be added to the plurality of polynucleotides. Such genes would not be random genes, or large groups of unselected human genes, as are commercially available now, but rather, would be specifically selected to complement the sets of genes identified by the present invention. For example, one of skill in the art may wish to add to the above-described plurality of genes one or more genes that are of relevance because they are expressed by a particular tissue of interest (e.g., lung tissue), are associated with a particular disease or condition of interest (e.g., NSCLC), or are associated with a particular cell, tissue or body function (e.g., angiogenesis). The development of additional pluralities of polynucleotides (and antibodies, as disclosed below), which include both the above-described plurality and such additional selected polynucleotides, are explicitly contemplated by the present invention.

According to the present invention, a plurality of polynucleotides refers to at least 2, and more preferably at least 3, and more preferably at least 4, and more preferably at least 5, and more preferably at least 6, and more preferably at least 7, and more preferably at least 8, and more preferably at least 9, and more preferably at least 10, and so on, in increments of one, up to any suitable number of polynucleotides, including at least 100, 500, 1000, $10^4$, $10^5$, or at least $10^6$ or more polynucleotides.

In one embodiment, the polynucleotide probes are conjugated to detectable markers. Detectable labels suitable for use in the present invention include any composition detectable by spectroscopic, photochemical, biochemical, immunochemical, electrical, optical or chemical means. Useful labels in the present invention include biotin for staining with labeled streptavidin conjugate, magnetic beads (e.g., Dynabeads™), fluorescent dyes (e.g., fluorescein, texas red, rhodamine, green fluorescent protein, and the like), radiolabels (e.g., $^3$H, $^{125}$I, $^{35}$S, $^{14}$C, or $^{32}$P), enzymes (e.g., horse radish peroxidase, alkaline phosphatase and others commonly used in an ELISA), and colorimetric labels such as colloidal gold or colored glass or plastic (e.g., polystyrene, polypropylene, latex, etc.) beads. Preferably, the polynucleotide probes are immobilized on a substrate.

In one embodiment, the polynucleotide probes are hybridizable array elements in a microarray or high density array. Nucleic acid arrays are well known in the art and are described for use in comparing expression levels of particular genes of interest, for example, in U.S. Pat. No. 6,177,248, which is incorporated herein by reference in its entirety. Nucleic acid arrays are suitable for quantifying a small variations in expression levels of a gene in the presence of a large population of heterogeneous nucleic acids. Knowing the identity of the genes of the present invention, nucleic acid arrays can be fabricated either by de novo synthesis on a substrate or by spotting or transporting nucleic acid sequences onto specific locations of substrate. Nucleic acids are purified and/or isolated from biological materials, such as a bacterial plasmid containing a cloned segment of sequence of interest. It is noted that all of the genes identified by the present invention have been previously sequenced, at least in part, such that oligonucleotides suitable for the identification of such nucleic acids can be produced. The database accession number for each of the genes identified by the present inventors is provided in Table 1. Suitable nucleic acids are also produced by amplification of template, such as by polymerase chain reaction or in vitro transcription.

Synthesized oligonucleotide arrays are particularly preferred for this aspect of the invention. Oligonucleotide arrays have numerous advantages, as opposed to other methods, such as efficiency of production, reduced intra- and inter array variability, increased information content and high signal-to-noise ratio.

One of skill in the art will appreciate that an enormous number of array designs are suitable for the practice of this invention. An array will typically include a number of probes that specifically hybridize to the sequences of interest. In addition, in a preferred embodiment, the array will include one or more control probes. The high-density array chip includes "test probes." Test probes could be oligonucleotides that range from about 5 to about 45 or 5 to about 500 nucleotides (including any whole number increment in between), more preferably from about 10 to about 40 nucleotides and most preferably from about 15 to about 40 nucleotides in length. In other particularly preferred embodiments the probes are 20 or 25 nucleotides in length. In another preferred embodiments, test probes are double or single strand DNA sequences. DNA sequences are isolated or cloned from natural sources or amplified from natural sources using natural nucleic acids as templates, or produced synthetically. These probes have sequences complementary to particular subsequences of the genes whose expression they are designed to detect. Thus, the test probes are capable of specifically hybridizing to the target nucleic acid they are to detect.

Another embodiment of the present invention relates to a plurality of antibodies, or antigen binding fragments thereof, for the detection of the expression of genes according to the present invention. The plurality of antibodies, or antigen binding fragments thereof, consists of antibodies, or antigen binding fragments thereof, that selectively bind to proteins encoded by genes described herein. According to the present invention, a plurality of antibodies, or antigen binding fragments thereof, refers to at least 2, and more preferably at least 3, and more preferably at least 4, and more preferably at least 5, and more preferably at least 6, and more preferably at least 7, and more preferably at least 8, and more preferably at least 9, and more preferably at least 10, and so on, in increments of one, up to any suitable number of antibodies, or antigen binding fragments thereof, including at least 100, 500, or at least 1000 antibodies, or antigen binding fragments thereof.

The invention also extends to non-antibody polypeptides, sometimes referred to as binding partners or antigen binding peptides, that have been designed to bind specifically to, and either activate or inhibit as appropriate, a target protein. Examples of the design of such polypeptides, which possess a prescribed ligand specificity are given in Beste et al. (*Proc. Natl. Acad. Sci.* 96:1898-1903, 1999), incorporated herein by reference in its entirety.

Limited digestion of an immunoglobulin with a protease may produce two fragments. An antigen binding fragment is referred to as an Fab, an Fab', or an F(ab')$_2$ fragment. A fragment lacking the ability to bind to antigen is referred to as an Fc fragment. An Fab fragment comprises one arm of an immunoglobulin molecule containing a L chain ($V_L$+$C_L$ domains) paired with the $V_H$ region and a portion of the $C_H$ region (CH1 domain). An Fab' fragment corresponds to an Fab fragment with part of the hinge region attached to the CH1 domain. An F(ab')$_2$ fragment corresponds to two Fab' fragments that are normally covalently linked to each other through a di-sulfide bond, typically in the hinge regions.

Isolated antibodies of the present invention can include serum containing such antibodies, or antibodies that have been purified to varying degrees. Whole antibodies of the present invention can be polyclonal or monoclonal. Alternatively, functional equivalents of whole antibodies, such as antigen binding fragments in which one or more antibody domains are truncated or absent (e.g., Fv, Fab, Fab', or F(ab)$_2$ fragments), as well as genetically-engineered antibodies or antigen binding fragments thereof, including single chain antibodies or antibodies that can bind to more than one epitope (e.g., bi-specific antibodies), or antibodies that can bind to one or more different antigens (e.g., bi- or multi-specific antibodies), may also be employed in the invention.

Generally, in the production of an antibody, a suitable experimental animal, such as, for example, but not limited to, a rabbit, a sheep, a hamster, a guinea pig, a mouse, a rat, or a chicken, is exposed to an antigen against which an antibody is desired. Typically, an animal is immunized with an effective amount of antigen that is injected into the animal. An effective amount of antigen refers to an amount needed to induce antibody production by the animal. The animal's immune system is then allowed to respond over a pre-determined period of time. The immunization process can be repeated until the immune system is found to be producing antibodies to the antigen. In order to obtain polyclonal antibodies specific for the antigen, serum is collected from the animal that contains the desired antibodies (or in the case of a chicken, antibody can be collected from the eggs). Such serum is useful as a reagent. Polyclonal antibodies can be further purified from the serum (or eggs) by, for example, treating the serum with ammonium sulfate.

Monoclonal antibodies may be produced according to the methodology of Kohler and Milstein (*Nature* 256:495-497, 1975). For example, B lymphocytes are recovered from the spleen (or any suitable tissue) of an immunized animal and then fused with myeloma cells to obtain a population of hybridoma cells capable of continual growth in suitable culture medium. Hybridomas producing the desired antibody are selected by testing the ability of the antibody produced by the hybridoma to bind to the desired antigen.

Finally, any of the genes of this invention, or their RNA or protein products, can serve as targets for therapeutic strategies. For example, neutralizing antibodies could be directed against one of the protein products of a selected gene, expressed on the surface of a tumor cell. Alternatively, regulatory compounds that regulate (e.g., upregulate or down-regulate) the expression and/or biological activity of a target gene (whether the product is intracellular, membrane or secreted), can be identified and/or designed using the genes described herein. For example, in one aspect, a method of using the genes described herein as a target includes the steps of: (a) contacting a test compound with a cell that expresses at least one gene, wherein said gene is selected from any one of the genes comprising, or expressing a transcript comprising, a nucleic acid sequence selected from the group consisting of SEQ ID NOs:1-194; and (b) identifying compounds, wherein the compounds can include: (i) compounds that increase the expression or activity of the gene or genes in (a), or the proteins encoded thereby, that are correlated with sensitivity to gefitinib; and (ii) compounds that decrease the expression or activity of genes in (a), or the proteins encoded thereby, that are correlated with resistance to gefitinib. The compounds are thereby identified as having the potential to enhance the efficacy of EGFR inhibitors.

The period of contact with the compound being tested can be varied depending on the result being measured, and can be determined by one of skill in the art. As used herein, the term "contact period" refers to the time period during which cells are in contact with the compound being tested. The term "incubation period" refers to the entire time during which cells are allowed to grow prior to evaluation, and can be inclusive of the contact period. Thus, the incubation period includes all of the contact period and may include a further time period during which the compound being tested is not present but during which expression of genes is allowed to continue prior to scoring. Methods to evaluate gene expression in a cell according to the present invention have been described previously herein.

If a suitable therapeutic compound is identified using the methods and genes of the present invention, a composition can be formulated. A composition, and particularly a therapeutic composition, of the present invention generally includes the therapeutic compound and a carrier, and preferably, a pharmaceutically acceptable carrier. According to the present invention, a "pharmaceutically acceptable carrier" includes pharmaceutically acceptable excipients and/or pharmaceutically acceptable delivery vehicles, which are suitable for use in administration of the composition to a suitable in vitro, ex vivo or in vivo site. A suitable in vitro, in vivo or ex vivo site is preferably a tumor cell. In some embodiments, a suitable site for delivery is a site of inflammation, near the site of a tumor, or a site of any other disease or condition in which regulation of the genes identified herein can be beneficial. Preferred pharmaceutically acceptable carriers are capable of maintaining a compound, a protein, a peptide, nucleic acid molecule or mimetic (drug) according to the present invention in a form that, upon arrival of the compound, protein, peptide, nucleic acid molecule or mimetic at the cell target in a culture or in patient, the compound, protein, peptide, nucleic acid molecule or mimetic is capable of interacting with its target.

Suitable excipients of the present invention include excipients or formularies that transport or help transport, but do not specifically target a composition to a cell (also referred to herein as non-targeting carriers). Examples of pharmaceutically acceptable excipients include, but are not limited to water, phosphate buffered saline, Ringer's solution, dextrose solution, serum-containing solutions, Hank's solution, other aqueous physiologically balanced solutions, oils, esters and glycols. Aqueous carriers can contain suitable auxiliary substances required to approximate the physiological conditions of the recipient, for example, by enhancing chemical stability and isotonicity.

Suitable auxiliary substances include, for example, sodium acetate, sodium chloride, sodium lactate, potassium chloride, calcium chloride, and other substances used to produce phosphate buffer, Tris buffer, and bicarbonate buffer. Auxiliary substances can also include preservatives, such as thimerosal, m- or o-cresol, formalin and benzol alcohol. Compositions of the present invention can be sterilized by conventional methods and/or lyophilized.

One type of pharmaceutically acceptable carrier includes a controlled release formulation that is capable of slowly releasing a composition of the present invention into a patient or culture. As used herein, a controlled release formulation comprises a compound of the present invention (e.g., a protein (including homologues), a drug, an antibody, a nucleic acid molecule, or a mimetic) in a controlled release vehicle. Suitable controlled release vehicles include, but are not limited to, biocompatible polymers, other polymeric matrices, capsules, microcapsules, microparticles, bolus preparations, osmotic pumps, diffusion devices, liposomes, liposheres, and transdermal delivery systems. Other carriers of the present invention include liquids that, upon administration to a patient, form a solid or a gel in situ. Preferred carriers are also biodegradable (i.e., bioerodible). When the compound is a recombinant nucleic acid molecule, suitable delivery vehicles include, but are not limited to liposomes, viral vectors or other delivery vehicles, including ribozymes. Natural lipid-containing delivery vehicles include cells and cellular membranes. Artificial lipid-containing delivery vehicles include liposomes and micelles. A delivery vehicle of the present invention can be modified to target to a particular site in a patient, thereby targeting and making use of a compound of the present invention at that site. Suitable modifications include manipulating the chemical formula of the lipid portion of the delivery vehicle and/or introducing into the vehicle a targeting agent capable of specifically targeting a delivery vehicle to a preferred site, for example, a preferred cell type. Other suitable delivery vehicles include gold particles, poly-L-lysine/DNA-molecular conjugates, and artificial chromosomes.

A pharmaceutically acceptable carrier which is capable of targeting is herein referred to as a "delivery vehicle." Delivery vehicles of the present invention are capable of delivering a composition of the present invention to a target site in a patient. A "target site" refers to a site in a patient to which one desires to deliver a composition. For example, a target site can be any cell which is targeted by direct injection or delivery using liposomes, viral vectors or other delivery vehicles, including ribozymes and antibodies. Examples of delivery vehicles include, but are not limited to, artificial and natural lipid-containing delivery vehicles, viral vectors, and ribozymes. Natural lipid-containing delivery vehicles include cells and cellular membranes. Artificial lipid-containing delivery vehicles include liposomes and micelles. A delivery vehicle of the present invention can be modified to target to a particular site in a subject, thereby targeting and making use of a compound of the present invention at that site. Suitable modifications include manipulating the chemical formula of the lipid portion of the delivery vehicle and/or introducing into the vehicle a compound capable of specifically targeting a delivery vehicle to a preferred site, for example, a preferred cell type. Specifically, targeting refers to causing a delivery vehicle to bind to a particular cell by the interaction of the compound in the vehicle to a molecule on the surface of the cell. Suitable targeting compounds include ligands capable of selectively (i.e., specifically) binding another molecule at a particular site. Examples of such ligands include antibodies, antigens, receptors and receptor ligands. Manipulating the chemical formula of the lipid portion of the delivery vehicle can modulate the extracellular or intracellular targeting of the delivery vehicle. For example, a chemical can be added to the lipid formula of a liposome that alters the charge of the lipid bilayer of the liposome so that the liposome fuses with particular cells having particular charge characteristics.

Another preferred delivery vehicle comprises a viral vector. A viral vector includes an isolated nucleic acid molecule useful in the present invention, in which the nucleic acid molecules are packaged in a viral coat that allows entrance of DNA into a cell. A number of viral vectors can be used, including, but not limited to, those based on alphaviruses, poxviruses, adenoviruses, herpesviruses, lentiviruses, adeno-associated viruses and retroviruses.

A composition can be delivered to a cell culture or patient by any suitable method. Selection of such a method will vary with the type of compound being administered or delivered (i.e., compound, protein, peptide, nucleic acid molecule, or mimetic), the mode of delivery (i.e., in vitro, in vivo, ex vivo) and the goal to be achieved by administration/delivery of the compound or composition. According to the present invention, an effective administration protocol (i.e., administering a composition in an effective manner) comprises suitable dose parameters and modes of administration that result in delivery of a composition to a desired site (i.e., to a desired cell) and/or in the desired regulatory event.

Administration routes include in vivo, in vitro and ex vivo routes. In vivo routes include, but are not limited to, oral, nasal, intratracheal injection, inhaled, transdermal, rectal, and parenteral routes. Preferred parenteral routes can include, but are not limited to, subcutaneous, intradermal, intravenous, intramuscular and intraperitoneal routes. Intravenous, intraperitoneal, intradermal, subcutaneous and intramuscular administrations can be performed using methods standard in the art. Aerosol (inhalation) delivery can also be performed using methods standard in the art (see, for example, Stribling et al., *Proc. Natl. Acad. Sci. USA* 189:11277-11281, 1992, which is incorporated herein by reference in its entirety). Oral delivery can be performed by complexing a therapeutic composition of the present invention to a carrier capable of withstanding degradation by digestive enzymes in the gut of an animal. Examples of such carriers, include plastic capsules or tablets, such as those known in the art. Direct injection techniques are particularly useful for suppressing graft rejection by, for example, injecting the composition into the transplanted tissue, or for site-specific administration of a compound, such as at the site of a tumor. Ex vivo refers to performing part of the regulatory step outside of the patient, such as by transfecting a population of cells removed from a patient with a recombinant molecule comprising a nucleic acid sequence encoding a protein according to the present invention under conditions such that the recombinant molecule is subsequently expressed by the transfected cell, and returning the transfected cells to the patient. In vitro and ex vivo routes of administration of a composition to a culture of host cells can be accomplished by a method including, but not limited to, transfection, transformation, electroporation, microinjection, lipofection, adsorption, protoplast fusion, use of protein carrying agents, use of ion carrying agents, use of detergents for cell permeabilization, and simply mixing (e.g., combining) a compound in culture with a target cell.

In the method of the present invention, a therapeutic compound, as well as compositions comprising such compounds, can be administered to any organism, and particularly, to any member of the Vertebrate class, Mammalia, including, without limitation, primates, rodents, livestock and domestic pets. Livestock include mammals to be consumed or that produce useful products (e.g., sheep for wool production). Preferred mammals to protect include humans. Typically, it is desirable to obtain a therapeutic benefit in a patient. A therapeutic benefit is not necessarily a cure for a particular disease or condition, but rather, preferably encompasses a result which can include alleviation of the disease or condition, elimination of the disease or condition, reduction of a symptom associated with the disease or condition, prevention or alleviation of a secondary disease or condition resulting from the occurrence of a primary disease or condition, and/or prevention of the disease or condition. As used herein, the phrase "protected from a disease" refers to reducing the symptoms of the disease; reducing the occurrence of the disease, and/or reducing the severity of the disease. Protecting a patient can refer to the ability of a composition of the present invention, when administered to a patient, to prevent a disease from occurring and/or to cure or to alleviate disease symptoms, signs or causes. As such, to protect a patient from a disease includes both preventing disease occurrence (prophylactic treatment) and treating a patient that has a disease (therapeutic treatment) to reduce the symptoms of the disease. A beneficial effect can easily be assessed by one of ordinary skill in the art and/or by a trained clinician who is treating the patient. The term, "disease" refers to any deviation from the normal health of a mammal and includes a state when disease symptoms are present, as well as conditions in which a deviation (e.g., infection, gene mutation, genetic defect, etc.) has occurred, but symptoms are not yet manifested.

Various aspects of the invention are described in the following examples; however, the following examples are provided for the purpose of illustration and are not intended to limit the scope of the present invention.

EXAMPLES

Example 1

The following example describes the identification of a biomarker panel that discriminates gefitinib-sensitive cell lines from gefitinib-resistant cell lines.

Methods: Gefitinib sensitivity was determined in 18 NSCLC cell lines using MTT assays. Cell lines were classified as gefitinib sensitive ($IC_{50}$<1 µM), resistant ($IC_{50}$>10 µM) or intermediate sensitivity (1 µM<$IC_{50}$>1). Oligonucleotide gene arrays (Affymetrix® Human Genome U133 set, 39,000 genes) were done on 10 cell lines. Three distinct filtration and normalization algorithms to process the expression data were used, and a list of genes were generated that were both statistically significant (unadjusted p=0.001 cut-off) and corrected for false positive occurrence. This approach was used in combination with 5 distinct machine learning algorithms used to build a test set for predictor genes that were successful for 100% of the test cases. The best discriminators (>3 fold difference in expression between sensitive and resistant cell lines) were selected for Real-time RT-PCR.

Results: A list of genes was generated initially from the Affymetrix array analysis. By using the mathematical algorithm, 14 different candidate genes were selected for RT-PCR. Twelve of the 14 genes were verified to discriminate between sensitive and resistant cell lines by Real-time RT-PCR.

Conclusion: Based on NSCLC cell line studies it was possible to identify genes which strongly discriminated gefitinib (Iressa) sensitive cell lines from the resistant ones. The genes are ranked in Table 1. This entire biomarker panel is of significant value for selecting NSCLC patients for gefitinib treatment.

TABLE 1

| Probe set | parametric p-value | mean intensity (resistant) | mean intensity (sensitive) | Gene symbol | Sequence Identifier | Description |
|---|---|---|---|---|---|---|
| 202286_s_at | 0.00000005 | 3.8 | 9893.5 | TACSTD2 | SEQ ID NO: 12 | tumor-associated calcium signal transducer 2 |
| 202489_s_at | 0.00000005 | 25.8 | 2372.6 | FXYD3 | SEQ ID NO: 16 | FXYD domain containing ion transport regulator 3 |
| 213285_at | 0.00000005 | 8.0 | 1739.3 | TMEM30B | SEQ ID NO: 73 | transmembrane protein 30B |
| 218186_at | 0.00000005 | 3.6 | 2295.0 | RAB25 | SEQ ID NO: 83 | RAB25, member RAS oncogene family |
| 235515_at | 0.00000005 | 6.4 | 287.6 | FLJ36445 | SEQ ID NO: 168 | hypothetical protein FLJ36445 |
| 235988_at | 0.00000005 | 11.3 | 345.7 | GPR110 | SEQ ID NO: 170 | G protein-coupled receptor 110 |

TABLE 1-continued

| Probe set | parametric p-value | mean intensity (resistant) | mean intensity (sensitive) | Gene symbol | Sequence Identifier | Description |
|---|---|---|---|---|---|---|
| 238689_at | 0.00000005 | 5.4 | 2210.5 | GPR110 | SEQ ID NO: 177 | G protein-coupled receptor 110 |
| 232165_at | 0.00000010 | 4.6 | 244.0 | EPPK1 | SEQ ID NO: 164 | epiplakin 1 |
| 240633_at | 0.00000010 | 6.2 | 61.2 | FLJ33718 | SEQ ID NO: 182 | hypothetical protein FLJ33718 |
| 219525_at | 0.00000020 | 179.3 | 6.1 | FLJ10847 | SEQ ID NO: 93 | hypothetical protein FLJ10847 |
| 229599_at | 0.00000020 | 5.9 | 112.8 |  | SEQ ID NO: 154 | Clone IMAGE: 5166045, Mrna |
| 203397_s_at | 0.00000030 | 10.1 | 1128.6 | GALNT3 | SEQ ID NO: 28 | UDP-N-acetyl-alpha-D-galactosamine:polypeptide N-acetylgalactosaminyltransferase 3 (GalNAc-T3) |
| 232164_s_at | 0.00000030 | 5.8 | 411.1 | EPPK1 | SEQ ID NO: 163 | epiplakin 1 |
| 212813_at | 0.00000060 | 163.8 | 7.9 | JAM3 | SEQ ID NO: 71 | junctional adhesion molecule 3 |
| 227134_at | 0.00000160 | 14.2 | 705.7 | SYTL1 | SEQ ID NO: 143 | synaptotagmin-like 1 |
| 236489_at | 0.00000170 | 8.2 | 498.5 |  | SEQ ID NO: 171 |  |
| 235651_at | 0.00000480 | 3.9 | 98.2 |  | SEQ ID NO: 169 |  |
| 238439_at | 0.00000700 | 7.7 | 537.6 | ANKRD22 | SEQ ID NO: 173 | ankyrin repeat domain 22 |
| 219388_at | 0.00000730 | 19.3 | 342.1 | TFCP2L3 | SEQ ID NO: 91 | transcription factor CP2-like 3 |
| 227985_at | 0.00000820 | 5.0 | 179.9 |  | SEQ ID NO: 146 |  |
| 227450_at | 0.00000890 | 5.1 | 509.7 | FLJ32115 | SEQ ID NO: 144 | hypothetical protein FLJ32115 |
| 203256_at | 0.00000980 | 13.4 | 2223.0 | CDH3 | SEQ ID NO: 23 | cadherin 3, type 1, P-cadherin (placental) |
| 220318_at | 0.00000980 | 4.4 | 44.7 | EPN3 | SEQ ID NO: 100 | epsin 3 |
| 202525_at | 0.00001030 | 7.8 | 1194.6 | PRSS8 | SEQ ID NO: 17 | protease, serine, 8 (prostasin) |
| 227803_at | 0.00001080 | 7.8 | 206.1 | ENPP5 | SEQ ID NO: 145 | ectonucleotide pyrophosphatase/phosphodiesterase 5 (putative function) |
| 206884_s_at | 0.00001200 | 12.8 | 822.7 | SCEL | SEQ ID NO: 49 | Sciellin |
| 223895_s_at | 0.00001290 | 13.8 | 183.6 | EPN3 | SEQ ID NO: 119 | epsin 3 |
| 238493_at | 0.00001650 | 7.3 | 18.5 | ZNF506 | SEQ ID NO: 174 | zinc finger protein 506 |
| 224913_s_at | 0.00001960 | 2703.8 | 1081.5 | TIMM50 | SEQ ID NO: 122 | translocase of inner mitochondrial membrane 50 homolog (yeast) |
| 201428_at | 0.00002330 | 90.3 | 3416.4 | CLDN4 | SEQ ID NO: 5 | claudin 4 |
| 216641_s_at | 0.00003760 | 26.8 | 423.5 | LAD1 | SEQ ID NO: 78 | ladinin 1 |
| 231929_at | 0.00003910 | 31.0 | 340.7 |  | SEQ ID NO: 159 | MRNA; cDNA DKFZp586O0724 (from clone DKFZp586O0724) |
| 212764_at | 0.00003930 | 320.0 | 9.2 | TCF8 | SEQ ID NO: 70 | transcription factor 8 (represses interleukin 2 expression) |
| 238778_at | 0.00004080 | 15.0 | 106.1 | MPP7 | SEQ ID NO: 178 | membrane protein, palmitoylated 7 (MAGUK p55 subfamily member 7) |
| 202641_at | 0.00004360 | 2011.3 | 933.3 | ARL3 | SEQ ID NO: 19 | ADP-ribosylation factor-like 3 |
| 212233_at | 0.00004550 | 2005.7 | 137.0 | MAP1B | SEQ ID NO: 66 | microtubule-associated protein 1B |
| 224232_at | 0.00004560 | 1054.1 | 438.3 | PX19 | SEQ ID NO: 120 | px19-like protein |
| 226905_at | 0.00004590 | 240.2 | 14.0 | MGC45871 | SEQ ID NO: 142 | hypothetical protein MGC45871 |
| 218553_s_at | 0.00004620 | 177.0 | 38.2 | KCTD15 | SEQ ID NO: 84 | potassium channel tetramerisation domain containing 15 |
| 215218_s_at | 0.00004830 | 368.6 | 142.8 | C19orf14 | SEQ ID NO: 77 | chromosome 19 open reading frame 14 |
| 203287_at | 0.00004920 | 23.4 | 505.0 | LAD1 | SEQ ID NO: 24 | ladinin 1 |
| 209114_at | 0.00005560 | 43.7 | 717.2 | TSPAN-1 | SEQ ID NO: 57 | tetraspan 1 |
| 230076_at | 0.00005660 | 21.2 | 120.1 |  | SEQ ID NO: 155 |  |
| 218677_at | 0.00005710 | 21.5 | 966.3 | S100A14 | SEQ ID NO: 85 | S100 calcium binding protein A14 |
| 236616_at | 0.00005810 | 17.8 | 32.9 |  | SEQ ID NO: 172 | CDNA FLJ41623 fis, clone CTONG3009227 |
| 205014_at | 0.00006280 | 13.4 | 491.2 | FGFBP1 | SEQ ID NO: 40 | fibroblast growth factor binding protein 1 |
| 200720_s_at | 0.00006360 | 1089.8 | 391.9 | ACTR1A | SEQ ID NO: 2 | ARP1 actin-related protein 1 homolog A, centractin alpha (yeast) |
| 224326_s_at | 0.00006750 | 499.6 | 135.5 | RNF134 | SEQ ID NO: 121 | ring finger protein 134 /// ring finger protein 134 |
| 242138_at | 0.00006800 | 207.4 | 6.9 | DLX1 | SEQ ID NO: 184 | distal-less homeo box 1 |
| 90265_at | 0.00007110 | 145.0 | 1117.7 | CENTA1 | SEQ ID NO: 193 | centaurin, alpha 1 |
| 222360_at | 0.00007190 | 97.8 | 21.2 | CGI-30 | SEQ ID NO: 108 | CGI-30 protein |
| 208393_s_at | 0.00007530 | 1370.0 | 596.5 | RAD50 | SEQ ID NO: 53 | RAD50 homolog (S. cerevisiae) |
| 226403_at | 0.00007930 | 22.5 | 680.1 | TMC4 | SEQ ID NO: 136 | transmembrane channel-like 4 |
| 232056_at | 0.00008450 | 9.8 | 141.7 | SCEL | SEQ ID NO: 160 | Sciellin |
| 207655_s_at | 0.00008700 | 7.1 | 71.1 | BLNK | SEQ ID NO: 51 | B-cell linker |
| 228683_s_at | 0.00009450 | 101.5 | 18.5 | KCTD15 | SEQ ID NO: 148 | potassium channel tetramerisation domain containing 15 |
| 204160_s_at | 0.00009570 | 23.9 | 314.8 | ENPP4 | SEQ ID NO: 36 | Ectonucleotide pyrophosphatase/phosphodiesterase 4 (putative function) |
| 202454_s_at | 0.00009860 | 16.3 | 1266.2 | ERBB3 | SEQ ID NO: 15 | v-erb-b2 erythroblastic leukemia viral oncogene homolog 3 (avian) |
| 232151_at | 0.00010020 | 8.5 | 295.7 |  | SEQ ID NO: 162 | MRNA full length insert cDNA clone EUROIMAGE 2344436 |
| 205073_at | 0.00010350 | 30.8 | 136.8 | CYP2J2 | SEQ ID NO: 41 | cytochrome P450, family 2, subfamily J, polypeptide 2 |
| 225658_at | 0.00011660 | 167.1 | 516.3 | LOC339745 | SEQ ID NO: 127 | hypothetical protein LOC339745 |
| 219150_s_at | 0.00012240 | 30.9 | 200.1 | CENTA1 | SEQ ID NO: 90 | centaurin, alpha 1 |
| 228882_at | 0.00012370 | 152.7 | 10.4 | TUB | SEQ ID NO: 150 | tubby homolog (mouse) |
| 222857_s_at | 0.00012430 | 17.2 | 344.7 | KCNMB4 | SEQ ID NO: 113 | potassium large conductance calcium-activated channel, subfamily M, beta member 4 |
| 55662_at | 0.00013490 | 84.7 | 31.7 | C10orf76 | SEQ ID NO: 191 | chromosome 10 open reading frame 76 |

TABLE 1-continued

| Probe set | parametric p-value | mean intensity (resistant) | mean intensity (sensitive) | Gene symbol | Sequence Identifier | Description |
|---|---|---|---|---|---|---|
| 204161_s_at | 0.00013900 | 12.5 | 69.3 | ENPP4 | SEQ ID NO: 37 | Ectonucleotide pyrophosphatase/phosphodiesterase 4 (putative function) |
| 205455_at | 0.00014640 | 20.1 | 333.2 | MST1R | SEQ ID NO: 42 | macrophage stimulating 1 receptor (c-met-related tyrosine kinase) |
| 221432_s_at | 0.00014780 | 108.4 | 34.4 | SLC25A28 | SEQ ID NO: 102 | solute carrier family 25, member 28 /// solute carrier family 25, member 28 |
| 203082_at | 0.00015630 | 1316.0 | 435.4 | BMS1L | SEQ ID NO: 20 | BMS1-like, ribosome assembly protein (yeast) |
| 223192_at | 0.00015890 | 391.2 | 207.2 | SLC25A28 | SEQ ID NO: 116 | solute carrier family 25, member 28 |
| 226084_at | 0.00017240 | 1660.7 | 87.5 | MAP1B | SEQ ID NO: 131 | microtubule-associated protein 1B |
| 229587_at | 0.00017530 | 247.0 | 86.2 | UBA2 | SEQ ID NO: 153 | SUMO-1 activating enzyme subunit 2 |
| 211071_s_at | 0.00018080 | 2398.5 | 76.5 | AF1Q | SEQ ID NO: 60 | ALL1-fused gene from chromosome 1q /// ALL1-fused gene from chromosome 1q |
| 214448_x_at | 0.00018290 | 310.0 | 123.8 | NFKBIB | SEQ ID NO: 74 | nuclear factor of kappa light polypeptide gene enhancer in B-cells inhibitor, beta |
| 225413_at | 0.00018660 | 8130.9 | 4324.6 | USMG5 | SEQ ID NO: 125 | upregulated during skeletal muscle growth 5 |
| 235036_at | 0.00018930 | 262.2 | 19.4 | MGC46719 | SEQ ID NO: 165 | hypothetical protein MGC46719 |
| 203441_s_at | 0.00019180 | 684.0 | 72.1 | CDH2 | SEQ ID NO: 31 | cadherin 2, type 1, N-cadherin (neuronal) |
| 235247_at | 0.00019200 | 6.2 | 262.8 | | SEQ ID NO: 167 | |
| 225096_at | 0.00019610 | 1755.7 | 703.7 | HSA272196 | SEQ ID NO: 124 | hypothetical protein, clone 2746033 |
| 205617_at | 0.00019960 | 9.2 | 23.1 | PRRG2 | SEQ ID NO: 44 | proline rich Gla (G-carboxyglutamic acid) 2 |
| 225822_at | 0.00020110 | 10.3 | 468.3 | MGC17299 | SEQ ID NO: 129 | hypothetical protein MGC17299 |
| 239077_at | 0.00020310 | 146.8 | 49.3 | GALNACT-2 | SEQ ID NO: 179 | chondroitin sulfate GalNAcT-2 |
| 218779_x_at | 0.00021870 | 72.0 | 404.0 | EPS8L1 | SEQ ID NO: 86 | EPS8-like 1 |
| 50314_i_at | 0.00022630 | 830.5 | 279.4 | C20orf27 | SEQ ID NO: 190 | chromosome 20 open reading frame 27 |
| 218792_s_at | 0.00023140 | 74.9 | 468.6 | BSPRY | SEQ ID NO: 87 | B-box and SPRY domain containing |
| 222664_at | 0.00024210 | 624.9 | 42.5 | KCTD15 | SEQ ID NO: 109 | potassium channel tetramerisation domain containing 15 |
| 201869_s_at | 0.00024250 | 290.8 | 70.5 | TBL1X | SEQ ID NO: 9 | transducin (beta)-like 1X-linked |
| 219855_at | 0.00024820 | 233.0 | 27.6 | NUDT11 | SEQ ID NO: 94 | nudix (nucleoside diphosphate linked moiety X)-type motif 11 |
| 203236_s_at | 0.00025890 | 81.3 | 318.7 | LGALS9 | SEQ ID NO: 22 | lectin, galactoside-binding, soluble, 9 (galectin 9) |
| 202167_s_at | 0.00026530 | 770.6 | 340.7 | MMS19L | SEQ ID NO: 10 | MMS19-like (MET18 homolog, S. cerevisiae) |
| 229221_at | 0.00026990 | 21.7 | 130.8 | | SEQ ID NO: 152 | |
| 201157_s_at | 0.00027160 | 2272.3 | 1323.6 | NMT1 | SEQ ID NO: 4 | N-myristoyltransferase 1 |
| 226187_at | 0.00027300 | 32.2 | 301.2 | CDS1 | SEQ ID NO: 132 | CDP-diacylglycerol synthase (phosphatidate cytidylyltransferase) 1 |
| 239671_at | 0.00028050 | 12.2 | 43.6 | | SEQ ID NO: 181 | CDNA FLJ31085 fis, clone IMR321000037 |
| 222746_s_at | 0.00028540 | 8.7 | 288.5 | BSPRY | SEQ ID NO: 111 | B-box and SPRY domain containing |
| 219858_s_at | 0.00029160 | 12.3 | 63.1 | FLJ20160 | SEQ ID NO: 96 | FLJ20160 protein |
| 210749_x_at | 0.00029280 | 507.7 | 2452.9 | DDR1 | SEQ ID NO: 59 | discoidin domain receptor family, member 1 |
| 211778_s_at | 0.00029620 | 20.3 | 334.6 | ZNF339 | SEQ ID NO: 61 | zinc finger protein 339 /// zinc finger protein 339 |
| 226876_at | 0.00030570 | 283.5 | 45.7 | MGC45871 | SEQ ID NO: 141 | hypothetical protein MGC45871 |
| 230323_s_at | 0.00033140 | 17.4 | 295.5 | LOC120224 | SEQ ID NO: 157 | hypothetical protein BC016153 |
| 221665_s_at | 0.00033480 | 20.5 | 172.5 | EPS8L1 | SEQ ID NO: 105 | EPS8-like 1 |
| 1007_s_at | 0.00033840 | 469.2 | 2729.2 | DDR1 | SEQ ID NO: 1 | discoidin domain receptor family, member 1 |
| 218891_at | 0.00034090 | 218.3 | 108.6 | C10orf76 | SEQ ID NO: 88 | chromosome 10 open reading frame 76 |
| 218960_at | 0.00034100 | 25.7 | 408.5 | TMPRSS4 | SEQ ID NO: 89 | transmembrane protease, serine 4 |
| 226876_at | 0.00030570 | 283.5 | 45.7 | MGC45871 | SEQ ID NO: 141 | hypothetical protein MGC45871 |
| 222668_at | 0.00034910 | 573.0 | 38.2 | KCTD15 | SEQ ID NO: 110 | potassium channel tetramerisation domain containing 15 |
| 217496_s_at | 0.00036040 | 593.8 | 172.2 | IDE | SEQ ID NO: 81 | insulin-degrading enzyme |
| 226213_at | 0.00036180 | 27.4 | 1639.9 | ERBB3 | SEQ ID NO: 133 | v-erb-b2 erythroblastic leukemia viral oncogene homolog 3 (avian) |
| 235202_x_at | 0.00036460 | 59.3 | 14.9 | IKIP | SEQ ID NO: 166 | IKK interacting protein |
| 212736_at | 0.00036600 | 290.0 | 27.4 | BC008967 | SEQ ID NO: 69 | hypothetical gene BC008967 |
| 203327_at | 0.00036980 | 410.7 | 105.9 | IDE | SEQ ID NO: 26 | insulin-degrading enzyme |
| 202597_at | 0.00037880 | 5.1 | 129.6 | IRF6 | SEQ ID NO: 18 | interferon regulatory factor 6 |
| 228865_at | 0.00037970 | 9.2 | 322.3 | SARG | SEQ ID NO: 149 | specifically androgen-regulated protein |
| 205709_s_at | 0.00038120 | 13.4 | 254.3 | CDS1 | SEQ ID NO: 45 | CDP-diacylglycerol synthase (phosphatidate cytidylyltransferase) 1 |
| 224946_s_at | 0.00039420 | 329.1 | 681.4 | MGC12981 | SEQ ID NO: 123 | hypothetical protein MGC12981 |
| 204856_at | 0.00039710 | 80.7 | 400.7 | B3GNT3 | SEQ ID NO: 39 | UDP-GlcNAc:betaGal beta-1,3-N-acetylglucosaminyltransferase 3 |
| 203317_at | 0.00039900 | 58.0 | 171.0 | PSD4 | SEQ ID NO: 25 | pleckstrin and Sec7 domain containing 4 |
| 221958_s_at | 0.00040170 | 171.2 | 468.6 | FLJ23091 | SEQ ID NO: 106 | putative NFkB activating protein 373 |
| 201130_s_at | 0.00040570 | 15.3 | 1183.0 | CDH1 | SEQ ID NO: 3 | cadherin 1, type 1, E-cadherin (epithelial) |
| 205458_at | 0.00042200 | 109.4 | 57.6 | MC1R | SEQ ID NO: 43 | melanocortin 1 receptor (alpha melanocyte stimulating hormone receptor) |
| 205847_at | 0.00042390 | 71.8 | 206.0 | PRSS22 | SEQ ID NO: 47 | protease, serine, 22 |
| 202340_x_at | 0.00043030 | 336.4 | 72.7 | NR4A1 | SEQ ID NO: 14 | nuclear receptor subfamily 4, group A, member 1 |
| 215146_at | 0.00043080 | 165.6 | 48.8 | KIAA1043 | SEQ ID NO: 76 | KIAA1043 protein |
| 223032_x_at | 0.00043320 | 5068.6 | 2903.7 | PX19 | SEQ ID NO: 115 | px19-like protein |
| 226535_at | 0.00044520 | 15.3 | 862.3 | ITGB6 | SEQ ID NO: 137 | integrin, beta 6 |
| 65517_at | 0.00045130 | 50.8 | 387.0 | AP1M2 | SEQ ID NO: 192 | adaptor-related protein complex 1, mu 2 subunit |
| 91826_at | 0.00045430 | 59.7 | 373.3 | EPS8L1 | SEQ ID NO: 194 | EPS8-like 1 |
| 238673_at | 0.00045640 | 44.3 | 578.2 | | SEQ ID NO: 176 | |

TABLE 1-continued

| Probe set | parametric p-value | mean intensity (resistant) | mean intensity (sensitive) | Gene symbol | Sequence Identifier | Description |
|---|---|---|---|---|---|---|
| 221610_s_at | 0.00046860 | 83.5 | 569.8 | STAP2 | SEQ ID NO: 104 | signal-transducing adaptor protein-2 |
| 203779_s_at | 0.00047400 | 17.8 | 143.2 | EVA1 | SEQ ID NO: 33 | epithelial V-like antigen 1 |
| 230312_at | 0.00047560 | 91.2 | 11.6 | | SEQ ID NO: 156 | |
| 211855_s_at | 0.00047620 | 355.5 | 97.2 | SLC25A14 | SEQ ID NO: 62 | solute carrier family 25 (mitochondrial carrier, brain), member 14 |
| 222830_at | 0.00047770 | 31.3 | 586.6 | TFCP2L2 | SEQ ID NO: 112 | transcription factor CP2-like 2 |
| 203780_at | 0.00047790 | 33.5 | 647.3 | EVA1 | SEQ ID NO: 34 | epithelial V-like antigen 1 |
| 223233_s_at | 0.00048700 | 37.9 | 541.0 | CGN | SEQ ID NO: 117 | cingulin |
| 219412_at | 0.00049410 | 6.2 | 241.9 | RAB38 | SEQ ID NO: 92 | RAB38, member RAS oncogene family |
| 219936_s_at | 0.00049770 | 5.8 | 171.1 | GPR87 | SEQ ID NO: 97 | G protein-coupled receptor 87 |
| 226226_at | 0.00049820 | 31.5 | 465.5 | LOC120224 | SEQ ID NO: 134 | hypothetical protein BC016153 |
| 222280_at | 0.00050070 | 312.5 | 152.0 | | SEQ ID NO: 107 | CDNA clone IMAGE: 6602785, partial cds |
| 225911_at | 0.00050990 | 6.9 | 142.2 | LOC255743 | SEQ ID NO: 130 | hypothetical protein LOC255743 |
| 223295_s_at | 0.00053580 | 463.2 | 264.9 | LUC7L | SEQ ID NO: 118 | LUC7-like (S. cerevisiae) |
| 212120_at | 0.00053760 | 1118.9 | 381.7 | RHOQ | SEQ ID NO: 65 | ras homolog gene family, member Q |
| 226584_s_at | 0.00053900 | 81.8 | 186.8 | C20orf55 | SEQ ID NO: 138 | chromosome 20 open reading frame 55 |
| 202328_s_at | 0.00054270 | 307.4 | 127.3 | PKD1 | SEQ ID NO: 13 | polycystic kidney disease 1 (autosomal dominant) |
| 208779_x_at | 0.00054830 | 489.8 | 2385.8 | DDR1 | SEQ ID NO: 55 | discoidin domain receptor family, member 1 |
| 203783_x_at | 0.00055660 | 33.6 | 14.8 | POLRMT | SEQ ID NO: 35 | polymerase (RNA) mitochondrial (DNA directed) |
| 208084_at | 0.00055660 | 29.0 | 347.8 | ITGB6 | SEQ ID NO: 52 | integrin, beta 6 |
| 213262_at | 0.00056350 | 597.1 | 48.5 | SACS | SEQ ID NO: 72 | spastic ataxia of Charlevoix-Saguenay (sacsin) |
| 225793_at | 0.00058010 | 1662.4 | 133.4 | MGC46719 | SEQ ID NO: 128 | hypothetical protein MGC46719 |
| 226678_at | 0.00058120 | 63.1 | 171.9 | UNC13D | SEQ ID NO: 139 | unc-13 homolog D (C. elegans) |
| 216949_s_at | 0.00058240 | 83.3 | 27.2 | PKD1 | SEQ ID NO: 80 | polycystic kidney disease 1 (autosomal dominant) |
| 212338_at | 0.00058710 | 28.0 | 335.5 | MYO1D | SEQ ID NO: 67 | myosin ID |
| 241455_at | 0.00059440 | 7.3 | 68.8 | | SEQ ID NO: 183 | |
| 214577_at | 0.00062040 | 279.3 | 58.3 | MAP1B | SEQ ID NO: 75 | microtubule-associated protein 1B |
| 220178_at | 0.00062110 | 193.7 | 48.8 | C19orf28 | SEQ ID NO: 99 | chromosome 19 open reading frame 28 |
| 201868_s_at | 0.00062220 | 103.1 | 21.6 | TBL1X | SEQ ID NO: 8 | transducin (beta)-like 1X-linked |
| 201679_at | 0.00063150 | 451.3 | 212.9 | ARS2 | SEQ ID NO: 6 | arsenate resistance protein ARS2 |
| 206043_s_at | 0.00063910 | 8.0 | 67.9 | KIAA0703 | SEQ ID NO: 48 | KIAA0703 gene product |
| 226706_at | 0.00063930 | 81.4 | 847.1 | FLJ23867 | SEQ ID NO: 140 | hypothetical protein FLJ23867 |
| 210255_at | 0.00064190 | 8.8 | 36.1 | RAD51L1 | SEQ ID NO: 58 | RAD51-like 1 (S. cerevisiae) |
| 208968_s_at | 0.00066500 | 2065.0 | 1181.4 | CIAPIN1 | SEQ ID NO: 56 | cytokine induced apoptosis inhibitor 1 |
| 207627_s_at | 0.00068160 | 401.7 | 205.1 | TFCP2 | SEQ ID NO: 50 | transcription factor CP2 |
| 203407_at | 0.00068500 | 39.6 | 1680.0 | PPL | SEQ ID NO: 29 | periplakin |
| 217791_s_at | 0.00069580 | 1777.8 | 837.7 | ALDH18A1 | SEQ ID NO: 82 | aldehyde dehydrogenase 18 family, member A1 |
| 225582_at | 0.00069740 | 415.9 | 44.7 | KIAA1754 | SEQ ID NO: 126 | KIAA1754 |
| 231721_at | 0.00070410 | 37.7 | 4.4 | JAM3 | SEQ ID NO: 158 | junctional adhesion molecule 3 |
| 222859_s_at | 0.00072460 | 24.0 | 133.1 | DAPP1 | SEQ ID NO: 114 | dual adaptor of phosphotyrosine and 3-phosphoinositides |
| 208595_s_at | 0.00074160 | 263.9 | 122.8 | MBD1 | SEQ ID NO: 54 | methyl-CpG binding domain protein 1 |
| 212015_x_at | 0.00075720 | 5744.3 | 3435.4 | PTBP1 | SEQ ID NO: 63 | polypyrimidine tract binding protein 1 |
| 219856_at | 0.00075780 | 13.9 | 230.4 | SARG | SEQ ID NO: 95 | specifically androgen-regulated protein |
| 38766_at | 0.00075940 | 85.9 | 281.7 | SRCAP | SEQ ID NO: 189 | Snf2-related CBP activator protein |
| P204744_s_at | 0.00076150 | 7537.7 | 3827.8 | IARS | SEQ ID NO: 38 | isoleucine-tRNA synthetase |
| 239196_at | 0.00076210 | 30.5 | 550.5 | ANKRD22 | SEQ ID NO: 180 | ankyrin repeat domain 22 |
| 203718_at | 0.00076760 | 424.0 | 138.4 | NTE | SEQ ID NO: 32 | neuropathy target esterase |
| 232149_s_at | 0.00076810 | 414.2 | 127.6 | NSMAF | SEQ ID NO: 161 | neutral sphingomyelinase (N-SMase) activation associated factor |
| 202264_s_at | 0.00076920 | 1513.7 | 830.7 | TOMM40 | SEQ ID NO: 11 | translocase of outer mitochondrial membrane 40 homolog (yeast) |
| 32069_at | 0.00077000 | 147.8 | 266.2 | N4BP1 | SEQ ID NO: 187 | Nedd4 binding protein 1 |
| 216862_s_at | 0.00078160 | 901.3 | 359.6 | MTCP1 | SEQ ID NO: 79 | mature T-cell proliferation 1 |
| 220370_s_at | 0.00079540 | 306.1 | 60.5 | USP36 | SEQ ID NO: 101 | ubiquitin specific protease 36 |
| 242191_at | 0.00080180 | 152.0 | 35.5 | | SEQ ID NO: 185 | LOC400781 |
| 203109_at | 0.00081840 | 2445.5 | 1097.7 | UBE2M | SEQ ID NO: 21 | ubiquitin-conjugating enzyme E2M (UBC12 homolog, yeast) |
| 205780_at | 0.00083050 | 39.8 | 941.1 | | SEQ ID NO: 46 | |
| 203440_at | 0.00\083250 | 503.5 | 78.6 | CDH2 | SEQ ID NO: 30 | cadherin 2, type 1, N-cadherin (neuronal) |
| 238513_at | 0.00083510 | 73.6 | 618.6 | TMG4 | SEQ ID NO: 175 | transmembrane gamma-carboxyglutamic acid protein 4 |
| 221550_at | 0.00083680 | 414.1 | 200.9 | COX15 | SEQ ID NO: 103 | COX15 homolog, cytochrome c oxidase assembly protein (yeast) |
| 229030_at | 0.00084650 | 5.9 | 70.1 | | SEQ ID NO: 151 | |
| 226400_at | 0.00088590 | 2284.5 | 4256.7 | | SEQ ID NO: 135 | |
| 37966_at | 0.00090730 | 127.8 | 9.3 | PARVB | SEQ ID NO: 188 | parvin, beta |
| 212424_at | 0.00092430 | 381.6 | 115.2 | PDCD11 | SEQ ID NO: 68 | programmed cell death 11 |
| 228441_at | 0.00093570 | 12.0 | 49.8 | | SEQ ID NO: 147 | |
| 203328_x_at | 0.00095810 | 411.3 | 112.2 | IDE | SEQ ID NO: 27 | insulin-degrading enzyme |
| 201680_x_at | 0.00095980 | 1383.3 | 765.5 | ARS2 | SEQ ID NO: 7 | arsenate resistance protein ARS2 |
| 243302_at | 0.00096750 | 14.2 | 29.1 | | SEQ ID NO: 186 | |
| 219969_at | 0.00097320 | 102.8 | 21.4 | CXorf15 | SEQ ID NO: 98 | chromosome X open reading frame 15 |
| 212016_s_at | 0.00099210 | 4187.6 | 2276.0 | PTBP1 | SEQ ID NO: 64 | polypyrimidine tract binding protein 1 |

Example 2

The following example describes the identification and further investigation of a target gene identified using the gene expression profile disclosed herein.

In this experiment, the present inventors describe research to examine the influence of E-cadherin-regulatory molecules on non-small cell lung cancer (NSCLC) response to EGF receptor (EGFR) inhibitors.

The EGFR, a member of the erbB family of tyrosine kinases (erbB1-4) plays a major role in transmitting stimuli that lead to NSCLC cellular proliferation and survival. EGFR, highly expressed in NSCLC, is a primary target for NSCLC therapeutic intervention. In clinical trials, 11-20% of patients with chemo-refractory advanced stage NSCLC responded to treatment with EGFR inhibitors such as gefitinib (Iressa®, ZD1839). Currently, there are no markers that predict which patients will respond to treatment. NSCLC patients with poor survival have decreased expression of E-cadherin, a cell adhesion molecule. E-cadherin expression is regulated by the wnt pathway and by zinc finger transcription factors including δEF1/ZEB1 and SIP1/ZEB2. Higher levels of protein expression of E-cadherin were detected in gefitinib sensitive NSCLC cell lines and expression was absent in gefitinib resistant lines. Conversely, expression of the E-cadherin inhibitors ZEB1 and SIP1 was higher in gefitinib resistant cell lines. The hypothesis of this project is that expression of E-cadherin and its regulatory molecules predict response to EGFR inhibitors, and modulating E-cadherin regulatory proteins may augment response to EGFR inhibitors in non-small cell lung cancer.

Figure 2:
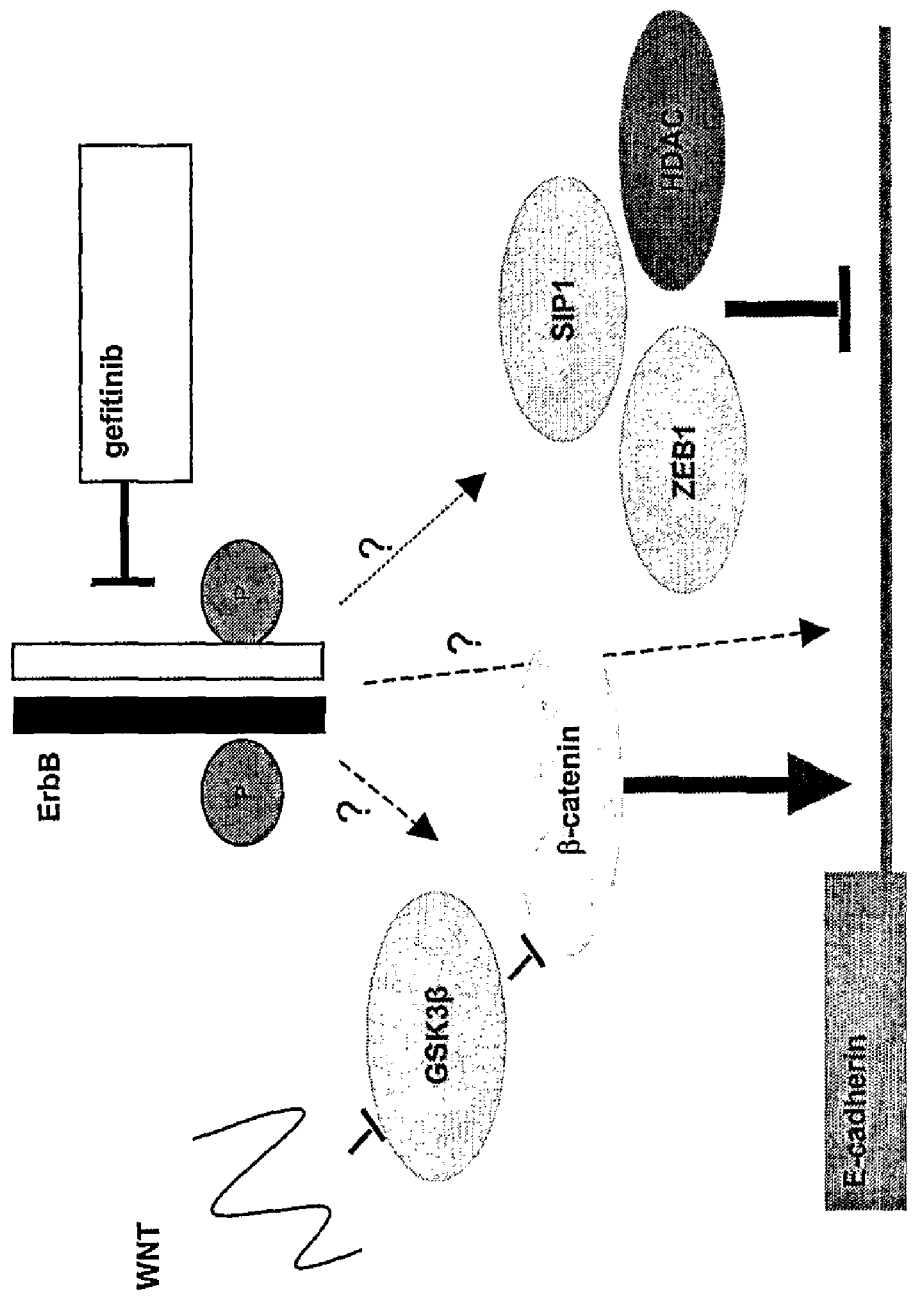
FIG. 2 is a schematic diagram showing E-cadherin regulation.

E-cadherin, a calcium-dependent epithelial cell adhesion molecule, plays an important role in tumor invasiveness and metastatic potential. Reduced E-cadherin expression is associated with tumor cell dedifferentiation, advanced stage and reduced survival in patients with NSCLC. At the transcriptional level, the wnt/β-catenin signaling pathway regulates DE-cadherin expression. The present inventors have reported that inhibition of GSK3β, involved in the proteasomal degradation of β-catenin, lead E-cadherin upregulation (FIG. 2). E-cadherin transcription is also regulated by zinc finger transcription factors including, Snail, Slug, ZEB1 and SIP1. They repress E-cadherin expression by binding to its promoter and recruiting HDAC (FIG. 2). The inventors have reported that inhibiting the ZEB1 or HDAC expression lead to upregulation of E-cadherin in NSCLC cell lines.

In this experiment, the inventors used NSCLC cell lines to: (1) evaluate the growth inhibitory properties of EGFR inhibitors by MTT assays, (2) to identify molecular molecules through DNA microarrays and westerns that predict response to EGFR inhibitors and (3) to design combination therapies that enhance the effect of the EGFR inhibitors. Cell lines were screened for expression of members of the EGFR and Wnt signaling pathways. E-cadherin expression was found to be lacking in gefitinib resistant cell lines and activated in gefitinib sensitive lines. Therefore, the expression of zinc finger transcription factors involved in E-cadherin repression was investigated. It was determined that gefitinib resistant lines have high ZEB1 and/or SIP1 expression, and expression is lacking in gefitinib-sensitive lines.

The inventors proposed that SIP1 and ZEB1 expression predicts EGFR tyrosine kinase inhibitors resistance and that modulating the molecular mechanism that regulate E-cadherin expression will enhance sensitivity to EGFR inhibitors. The proposal will be tested by manipulating E-cadherin expression and measuring the effect on response to gefitinib. Results of this work will be evaluated in clinical trials in patients with NSCLC.

Results

EGFR, pEGFR Her2, ErbB3 and Erb4 Expression in NSCLC:

EGFR, Her-2 and ErbB3 cell surface expression was evaluated using flow cytometry (Table 2). The majority of NSCLC cell lines (15/18) had a high percentage of EGFR positive cells and three had low or now EGFR expression. The two BAC cell lines, H322 and H358, had high expression of EGFR and Her2.

TABLE 2

| Cell Line | FACS % EGFR/ MFI | FACS % Her2/ MFI | FACS % ErbB3/ MFI | IC 50 uM ZD 1839 |
|---|---|---|---|---|
| Adenocarcinoma | | | | |
| Calu3 | 98%/8.9 | 100/37 | 32/4.3 | <1 |
| Colo699 | 0/0 | 0/0 | 57/2.3 | 4.1 |
| H125 | 100/34 | 91/2.8 | 0/0 | 4.7 |
| H2122 | 94/5.1 | 73/4 | 80/5 | 4.8 |
| H1435 | 98/14 | ND | 94/6.4 | 7.6 |
| A549 | 99/14 | 72/2.4 | 54/3.5 | 8.4 |
| H441 | 78/6.9 | 79/2.6 | 0/0 | 11.7 |
| H1648 | 98/5.7 | 78/2.7 | 0/0 | 11.5 |
| Bronchoalveolar | | | | |
| H322 | 100/16 | 96.5.5 | ND | <1 |
| H358 | ND | ND | ND | <1 |
| Squamous Cell | | | | |
| NE18 | 100/16 | 98/3.3 | 35/5.7 | 8 |
| H1703 | 99/15 | 65/2.6 | 0/0 | 9.3 |
| H157 | 93/13 | 62/1.8 | 0/0 | 10.1 |
| H520 | 0/0 | 0/0 | 0/0 | 10.3 |
| H1264 | 100/14 | 43/1.9 | 0/0 | 10.2 |
| Large Cell | | | | |
| H1334 | 100/23 | 74/3.2 | 99/10 | 3.8 |
| H460 | 37/1.9 | 57/1.4 | 0/0 | 9/9 |

Figure 3:
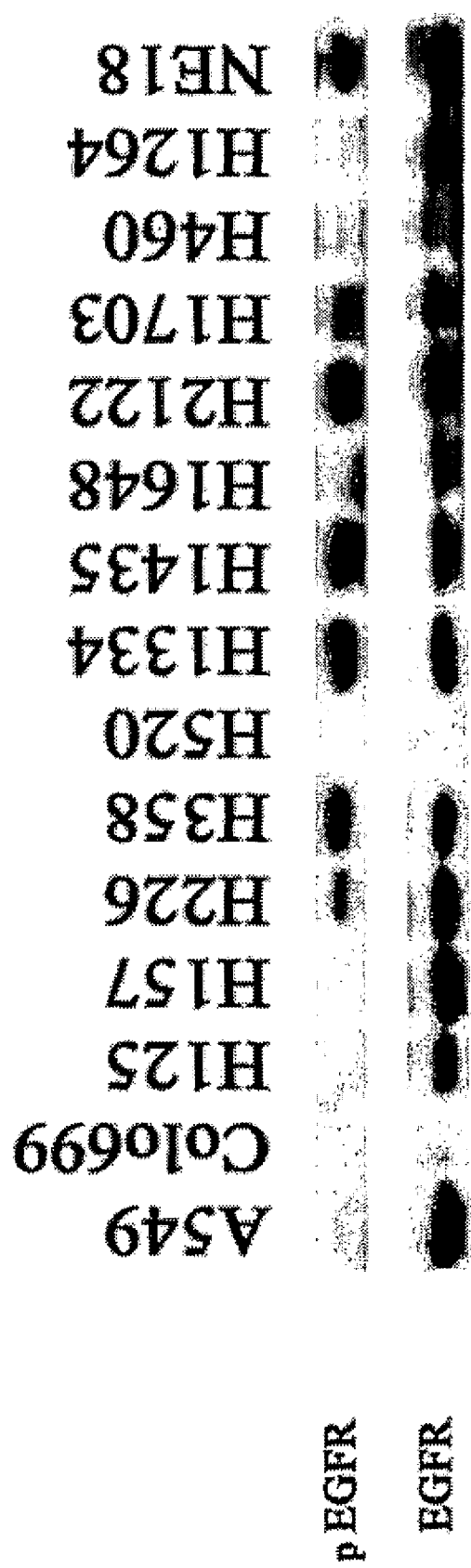
FIG. 3 is a digital image showing the expression of EGFR and phosphorylated EGFR in NSCLC cell lines.

The presence of phosphorylated EGFR (pEGFR) versus EGFR was evaluated by Western blotting in 18 NSCLC cell lines (FIG. 3, shows 15 cell lines). EGFR was detected in the majority of NSCLC cell lines, whereas only a subset of these cell lines had (pEGFR).

Figure 4:
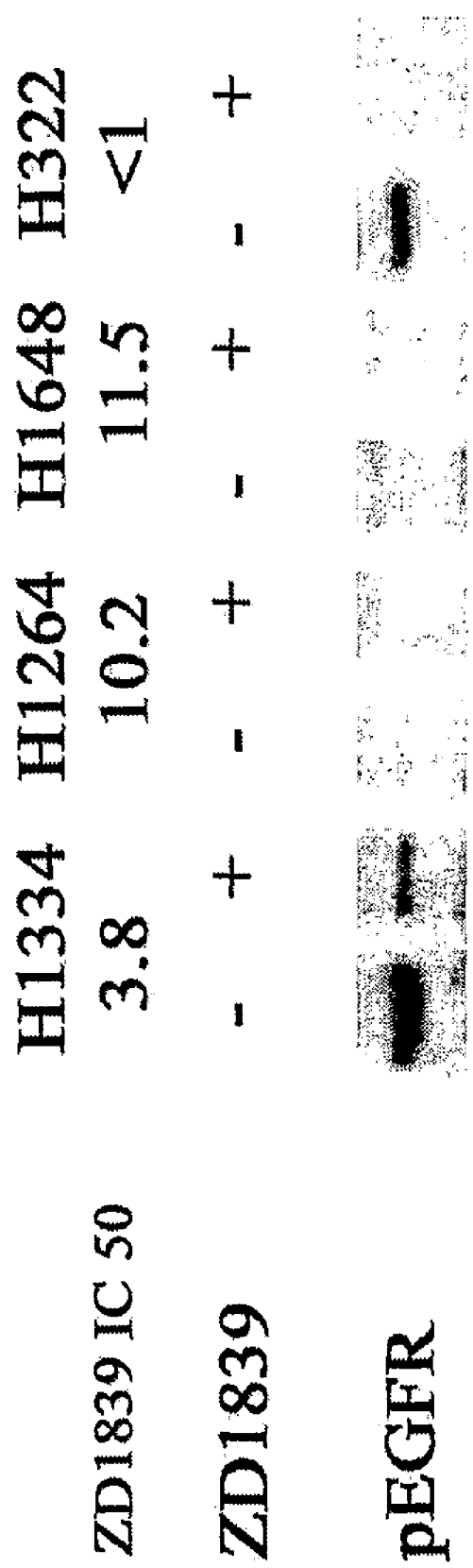
FIG. 4 is a digital image showing that ZD1839 downregulates pEGFR in sensitive NSCLC cell lines.

Effects of EGFR Inhibitors on Human Lung Cancer Cells Growth:

The growth inhibitory effect of gefitinib, on 18 NSCLC cell lines was evaluated using the MTT assay (Table 2). There was no correlation between the EGFR expression and gefitinib response. The change in pEGFR following gefitinib treatment was evaluated in two sensitive cell lines, H1334 and H322, and two resistant cell lines, H1264 and H1648 (FIG. 4). Gefitinib inhibited the phosphorylated "active" form of EGFR in sensitive cell lines.

Figure 5:
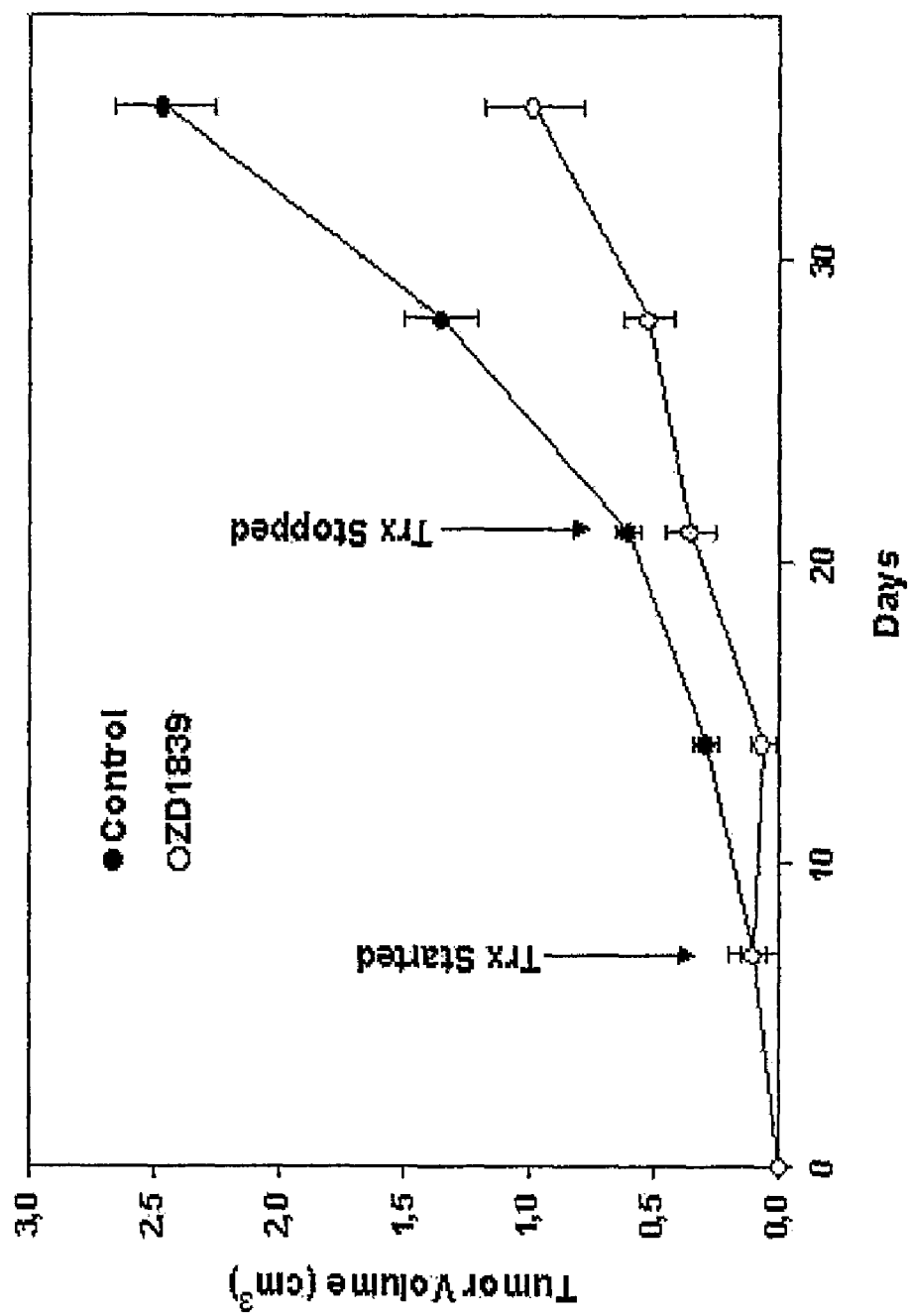
FIG. 5 is a line graph showing the effects of gefitinib on A549 NSCLC xenografts.

Based on the in vitro experiments, athymic nude mice bearing human NSCLC xenografts were treated with EGFR inhibitors ZD1839 or C225. Growth delay was evident in tumors after treatment with either agent (FIG. 5).

Figure 6:
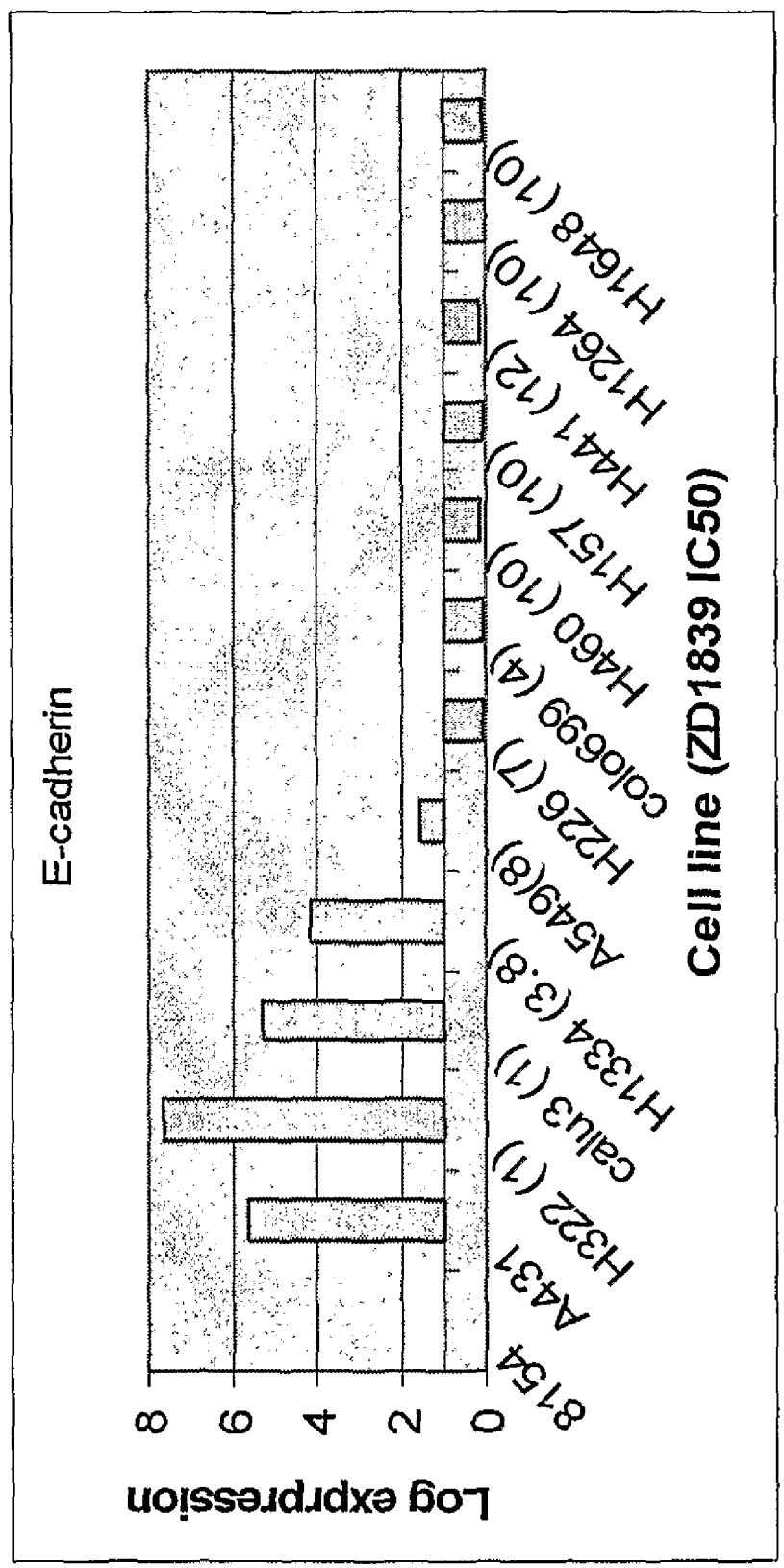
FIG. 6 is a bar graph showing the expression of E-cadherin in NSCLC cell lines using GeneSpring analysis of microarrays.

E-Cadherin SIP1 and ZEB1 in NSCLC Cell Lines Using Microarray and RT-PCR and Western Blotting:

High density oligonucleotide microarray (IOAM) analysis of gene expression levels of selected genes was developed from 11 NSCLC cell lines. These cell lines included 2 gefitinib sensitive lines ($IC_{50}$<1 μM) 5 gefitinib resistant lines ($IC_{50}$≧10 μM), and 4 lines with intermediate sensitivity ($IC_{50}$>1 μM, <10 μM). The expression of E-cadherin, SIP1 and ZEB 1 was evaluated and compared to their expression in normal bronchial epithelium using the Gene Spring program (FIG. 6).

Figure 7:
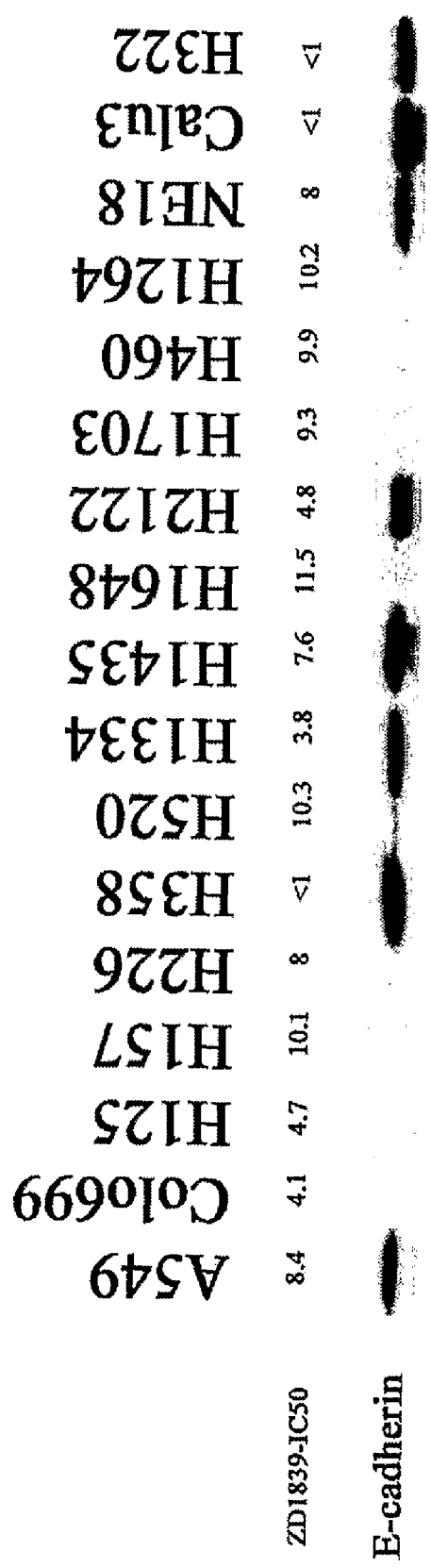
FIG. 7 is a digital image showing Western blot analysis of E-cadherin expression in NSCLC cell lines.

E-cadherin expression was more pronounced in gefitinib sensitive lines absent in gefitinib resistant lines. This expression pattern was confirmed using western blotting and real time PCR (RT-PCR) (FIG. 7).

Figure 8:
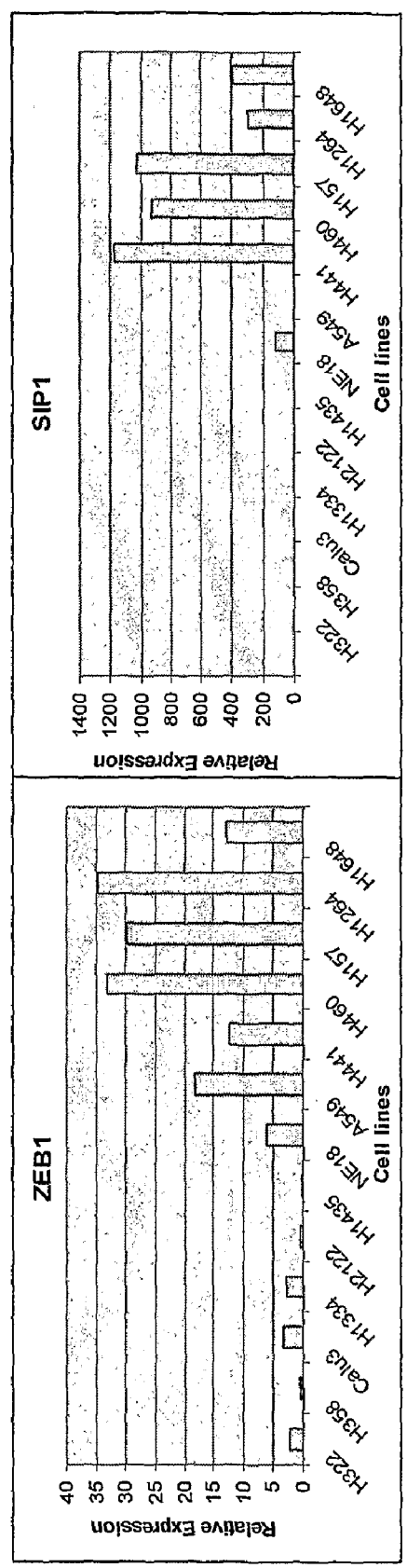
FIG. 8 is a bar graph showing real time RT-PCR analysis of ZEB1 and SIP1 expression in NSCLC cell lines.

As discussed above, regulation of E-cadherin expression involves the zinc finger transcription factors ZEB1 and SIP1. Expression of both transcription factors was evaluated using real time RT-PCR. ZEB 1 and SIP 1 were expressed in the gefitinib resistant lines and absent in the gefitinib sensitive lines (FIG. 8). The expression of Slug, Snail, Wnt7a, β-catenin, γ-catenin, α-catenin and GSK3β was also evaluated using Western blot analysis or RT-PCR. None of theses molecules had a differential pattern of expression in the NSCLC lines (data not shown).

In summary, there was no correlation between gefitinib sensitivity and EGFR expression. E-cadherin was detected preferentially in gefitinib sensitive lines. Conversely, the zinc finger transcription factors, ZEB1 and SIP1, involved in E-cadherin inhibition were expressed in gefitinib resistant lines and absent in gefitinib sensitive lines.

Example 3

This example describes the evaluation of the detrimental effect of the zinc finger proteins ZEB 1 and SIP 1 on NSCLC cell lines sensitivity to EGFR inhibitors.

In the first part of this experiment, adenoviral constructs containing ZEB1 or SIP1 are used to overexpress these proteins in gefitinib sensitive cell lines. MTT assay will assess changes in gefitinib sensitivity. In the second part of this experiment, stably transfected ZEB1 and SIP1 cell lines and untransfected cell lines are implanted into nude mice. Transplanted mice are treated with gefitinib and the response is compared between the two groups.

Example 4

This example describes the determination of the molecular mechanisms that improve the response to EGFR inhibitors in NSCLC cell lines in vitro and in vivo.

Figure 9:
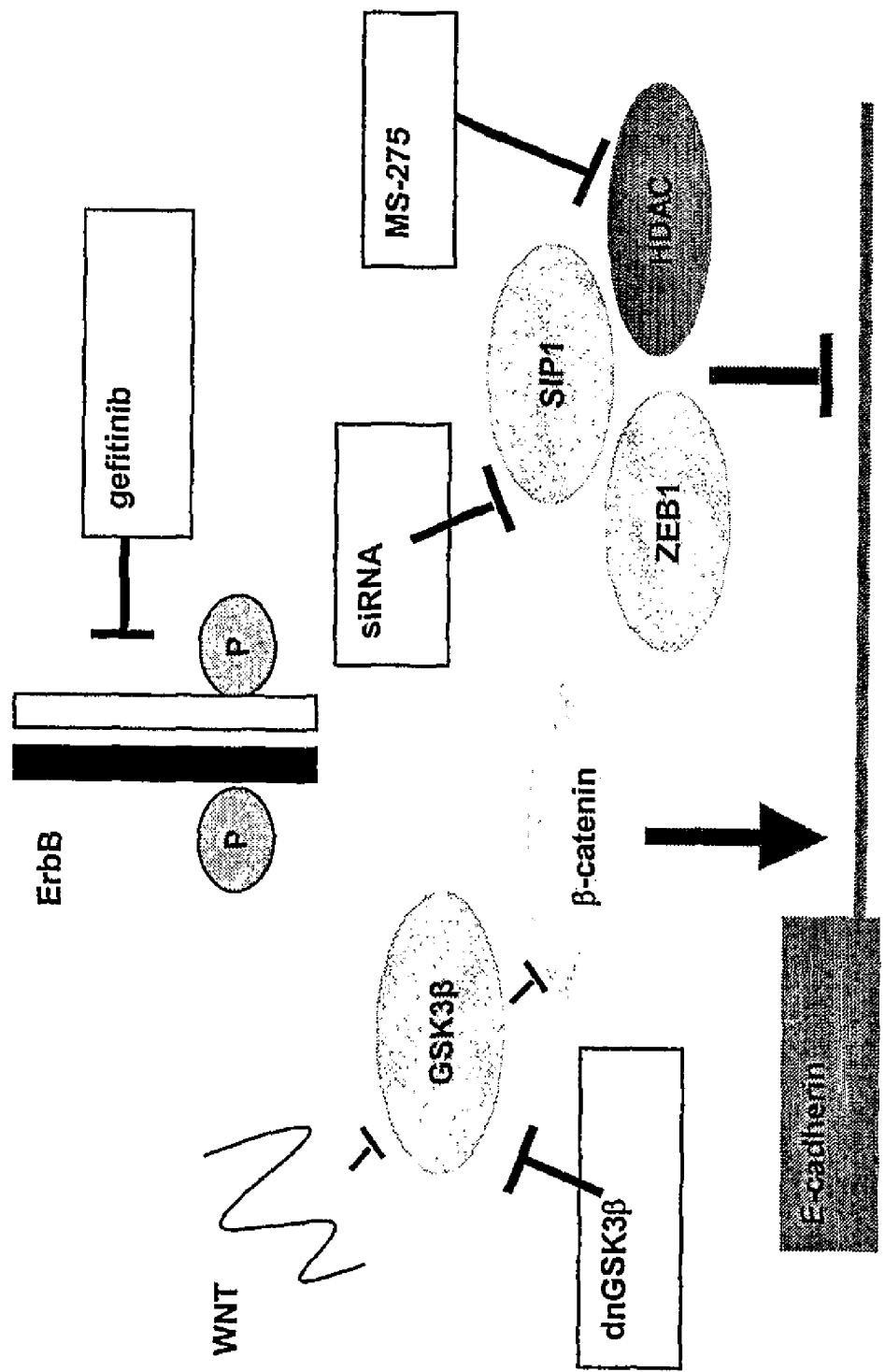
FIG. 9 is a schematic drawing showing the use of siRNA to silence the E-cadherin transcriptional repressors, SIP1 and ZEB1 to determine the effect on NSCLC cell line responses to ZD1839.

In the first part of this experiment, the effect of "silencing" the E-cadherin transcriptional repressors, SIP1 and ZEB1, on NSCLC cell lines response to ZD1839 is examined. To directly examine the role of the zinc-finger transcription factors, SIP1 and ZEB1 on gefitinib responsive lines, the effect of siRNA is developed and tested (FIG. 9). siRNA is prepared for different regions of SIP1 and ZEB1 using the silencer kit from Dharmacon (Colorado). Their efficacy is tested by RT-PCR. The most effective siRNA for SIP1 and ZEB1 are then introduced, individually or in combination, into gefitinib resistant lines. The effect of these siRNAs on gefitinib responsiveness is evaluated by MTT assay. ZEB1 antibody (Santa Cruz, Calif.) and SIP1 antibody (a gift from Dr. van Grunsven) are used to evaluate the efficacy of RNA inhibition.

In the second part of this experiment, the effect of inhibiting GSK3β on gefitinib response in NSCLC cell lines is examined. GSK3β phosphorylates β-catenin leading to its ubiquitination and destruction. GSK3β inhibitors, such as lithium, increased E-cadherin expression in NSCLC cell lines. GSK3β function is inhibited with an adenovirus (pAdTrack-CMV) encoding a dominant-negative GSK3β (dnGSK3β). To determine the effectiveness of this dnGSK3 the expression of non-phosphorylated β-catenin and E-cadherin is evaluated by western blot. NSCLC cell lines stably transfected with the dnGSK3β construct are generated. The effect of inhibiting GSK3β on NSCLC cell lines response to gefitinib are evaluated using MTT assays.

In the third part of this experiment, the effect of E-cadherin on gefitinib sensitivity is evaluated. Resistant NSCLC lines are transfected with E-cadherin encoding constructs. Changes in NSCLC cell lines response to gefitinib are assessed by MTT assay. Gefitinib-sensitive lines that express E-cadherin are treated with an E-cadherin antibody (Zymed) and the effect on gefitinib responsiveness assessed by MTT assay. The results determine whether expression of E-cadherin itself is sufficient to determine gefitinib sensitivity, or if sensitivity is a reflexion of events occurring upstream of it.

In the fourth part of this experiment, the effect of gefitinib responsiveness on NSCLC cell lines is augmented in vivo. Based on findings from the above in vitro experiments, the best treatment that enhances gefitinib sensitivity in NSCLC cell lines is selected for in vivo experiments in nude mice. Previously, the inventors showed an inhibitory effect of gefitinib alone on NSCLC xenografts growth (see above). The combination of gefitinib with one of the above-evaluated interventions is tested in athymic nude mice bearing human NSCLC xenografts. E-cadherin inducible cell lines from the in vitro experiments are inoculated subcutaneously in nude mice. Mice are treated with gefitinib with and without the agent that improved the gefitinib sensitivity. The two groups are evaluated for differences in tumor growth inhibition. Expression of E-cadherin, SIP1 and ZEB1 are evaluated both prior to and post-treatment by real-time RT-PCR and immunohistochemistry. ZEB1 antibody (Santa Cruz, Calif.) and SIP1 antibody (a gift from Dr. van Grunsven) are used in the immunohistochemistry. However, new antibodies can readily be generated if the above antibodies are not effective at detecting proteins in the IHC assays.

The results of these experiments dissect out the events leading to gefitinib resistance in order to develop treatment modifications that bypass resistance.

Each publication and reference cited herein is incorporated herein by reference in its entirety. U.S. Provisional Application Ser. No. 60/538,682, filed Jan. 23, 2004, is incorporated herein by reference in its entirety.

While various embodiments of the present invention have been described in detail, it is apparent that modifications and adaptations of those embodiments will occur to those skilled in the art. It is to be expressly understood, however, that such modifications and adaptations are within the scope of the present invention, as set forth in the following claims.

SEQUENCE LISTING (194 sequences)

SEQ ID NO: 1 - DNA, 12010 bp, Homo sapiens
  misc_feature (1)..(12010): n = a,c,t, or g
ctggaggaggacaaagggatgggggagtatcccccactcctcctacctcctggggtgacctgccttccttgtctttagacccgccctcgtctccaaggcaactcagcctttcctcagtccctcagaggcagccaccttctggaagtgggaactggggggactggatgtctgggtctcaggaaggcagagcagggataactgggcccaagatgccctgaacctgataagaggtggcagtcgagtccctcaggactccagggcctggagacttcagtacagggctctgagaccagtacaggttaggatagcttttcctgcagcaggggaggggagagtagttacttgggtttgtaaggagatgccatttagaatagttttatgtggggtaagcttcctgggcctgaggaacagagtagggattttcaaactttaatgggcacaggtcacctgggaattgtgttaaaaggcagatttggattgaacaggtcaagggtgagcctgagattctgatttcttccatgcttccaggtattgctgatggtccagggaccaccctgggcctagagggctatagggggacagtaagactagaaggtgctggggtcccctctgcccttctcttagaattctggactcctatgtgggagggcaacagggtgagctggtccaggcttatctgatgtttaattctatcatatcctcaacaaggaattgcccaacctttcctgggacatatttattttttaaaagtccaaatgattttcatattcttttacatatcttatgattttacataaatgcatttatgttacaagatttagaaaaatagtacaatcaacctgtctttttaaatttgcttttcttttgccccgttcatgttaactcttgttatattgtatgctattgttatattctattatatattctctccttctagacgtacacacaggtatatatacaaacatgggtgcttgtttattctattttcaaaaggtgggagattttttatacttctgttgcttgcttttcatattcaacagatatacatggaaatcacacaaagttaggaatatattgcctctttgttacttttcatagctgcatagtagtcaataaaccttattttttttaattccagcctgtcccctgtgggcattcacatatcttacagatttatgtcttacaaaaggtaccataataaacatctttgaaatcttcttttttatttttatttttcactttttttaaaagagatggggtctcactatgttcaccaggctggtctctaactcctggcctcaagtgatcctcccatctcggcctcccaaagtgctggggttacaggcatgagccaccagacccagacctgcacatatgttcttacttcctggtgcttctctctcgagggaatgctgggtcgaagaggatgtgcatttttaattataatagacattgctagattgctttccaaatagaagataacactcatttctgccattgagcatggtgcctcccttttcatcactttctaccacttttatatgttacagccttaaaaaaatatcttgtcagtctgcttggtatttccctgaggctagtgaatttgaccattaaaaaaaatgtttgttggcaatttggctttgcttttctgtgaaatgactatccacattctttggctgtttctttattgggttacttatatattttttcttgtcagttcctaaggggccttagtttattgtagttattaaaccttttcctgttgtatgtgttataaacattttttgcacacttgttgtttgttctaagccgttgtttatggggatattttgcccattcctgattggggaaatggggctttaggaagttatttaactgatctctgccctagtttcttcatgtgttaaatatggatagtaatagtatctaccttatgaagtgactgtgaagataaaattatggattctgtttaagggtttaggccagtgtctggcacaggggaagcattctaaaaatatagctgatgctgttaaacaatgactgttgttgttgttttactgttattatccccaaagcggcccattctgtctgttgctgtcagctatgactcagtcccctgattaacttacgcaccacccattttatcccctgcagagatgctgcccccacccccttaggcccgagggatcaggagctatgggaccagaggccctgtcatctttactgctgctgctcttggtggcaagtggagatgctgacatgaagggacattttgatcctgccaagtgtcgctatgccctgggcatgcaggaccggaccatcccagacagtgacatctctgcttccagctcctggtcagattccactgccgcccgccacagcaggtacttggcacacctggcacacttgtagctgccccgagaggagctcctgggacctctacttcccctccaacccctctgcccacgccagtgaaacccctgcaggctgagggggcaaatgaagtggggtttaaatactggagatggaggcagacctggggccagatgttctctgtgcccctcttcaccctcaggttggagagcagtgacggggatggggcctggtgccccgcagggtcggtgtttcccaaggaggaggagtacttgcaggtggatctacaacgagtgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagtgtctgtctgcgggtagagctctatggctgcctctggaggggtgagtggctcagcttcctgggaatctgtttcctgagcaggggactggagggtggggagtgtggcgaatggacattttaggatcccttctcctggtgggaagctgtcactctgaggagggggctagccagcattgtctcctccatgccaatgagccagtggagagatacaagaagggacctgaaacctgcccaggcctgatgaagggatgggggatggagtcttagtgcctctgacccccaccctcttattttttcccagatggactcctgtcttacaccgcccctgtggggcagacaatgtatttatctgaggccgtgtacctcaacgactccacctatgacggacataccgtggggggtaagaaaggcccctgcaggatatggagtttggggtgggagggaggactctgtgtgtgtgtgtgtgtgtgtgtgtctgtgtgtgtgtgagtgtgtgtgtgtaggggggctggtaagtagggtggggagtgagatggaagagcagagaagagggatgggtaaggtgggncctcaaagggtaacactagggtgaccactagcccgtatgacactggatgtagaagagtcacccctttgctaacacacattgttggaaattgctccaataaatatacacatcatagattgaaatggtgccccttagaggtggtgcctttgtgctggatgtgacctgcaaggtacctgtagtgctggggtggggtggagagaggagaagggccagctgcatgagtgtgaggcgggatgggaatgggactagtggatgggagccaggctggccatgccactgtgccggagggtggcggagcagaatgcctggatgtcaagaccctcttcccttccaacctcctcttccttggtcccctcttctccggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtgagtgagtccggctctcgaggagggctctgaagccatgcagggtgccgttggggtgcccccaccactcctagccttgaccctgtgccctcttcccttccccccaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctggtaagccctggagtagcccagtctccagtccctgaaattgacaactgagttcattcctaaccctgcagtgtccctaaaatactcattcctcgcattatatctacccatcacccaccgaaacttctcaattaggggtgccccaaataacttgagcccctctctgcctcttgttctctgcgtatccatctttcctttgtaagccccttgcccgtgactattattgagccagtatgacagtactggttgttaaaatattgaaatacttctgtattagttgagaaatagcctcttctctaagcctccagatacctgtcctccacctccccacaatccagcaactatagggttaacacccaccacagctgggtgttccaggaccctgctcccccagcccccactggtcagtggttgcctattgagaatcacccatgcttctgctcctttgcacaacagtccactgcctctgcctcccttgggtctcctcctcatttacctccctcctttctttttgttccttctccccagatgtggtgaacaattcctctccggcactgggaggcaccttcccgccagccccctggtggccgcctggcccacctcccaccaacttcagcagcttgggtgagcaatcttgggtgggcgtgtggaccctctgcacccttctccctgggcctccccctcggctagggtgggaccctcctgtggtgctgaccctgctgcctccaccagagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggtgggcacagccgtggcatgtggagtggcggggggaggccaggccccagcacgagccagcgtccagtgggacctgcagggcacagcccactagcatcccaagaggagggcttagtaaagagaccacttacaccatgtcaaagagggtatggggctcacagggagggctgctccccagctctgggtctgctcagcggagaggagcaaataccacgacccagaggagagagtctgtggagagggcaccttgacaggggcagtagactttggtcctgggatgcagctggtcccgttatctacccctcagggagggcctgggagagtagatgccctgacctcacttttctgtgccaaactcctgctgggctcctctctggctaaacccaaaccaggcctgttgttgcagtgtacactggtcacccttggggcagaagcagggtagagacaggcagagagtggggttggaggggcaaagggaagacgtctgncacaccccaagccacgtcttccggctggagtccagtggcagtaatatacattaaggttgatgactggacacggtggctcatgcctgtaatcctagcactttgggagaccgaggcgggaggatcacctgaggtcaagagttcgagaccagcctgaccaacatggtgaaatcccatctctactaagaataccaaattagccaggcatggtggctgatgcctgtaatcccagctactcaggaggctgaggcatgaatctcttgaacctgggaggcgaaggttgcagtgagctgagatcatgccatttcacttcagcctgggcgacaagagccaaattccatctccaaaaaacaaacaaaccaaaaaaaacggttgatagttatggactgggcagatgagggttagaatctcattgtggggcagggaagttacctccatgctcttgagcttcactttctctgcctgtaagatggtgctgatagtatccacagctgtagggctcttgtgagggctgagggagggaacgcagggatggacacagcagagggccaggccgtgtgtgctgagcaacacgggtgatgcctcccatccctatgacaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctggtaagacctgccttgttccagtcgcacctctgtcctctctgctgttttcttattgtatccctttcccattctctttttttcctgtcttccccagtttccacttgttttcttctttctgtgcccctggttactgtctatatcactctttggtccctaccatgtagtctctctcaagagttccccatgtattacccatagtcccccgtggtgctatcttgtctgtgtcccacagacatctctctatctttgttgtaccctctcattgtgtctccctggcccctttgatttgtattagactcaccatgtttggttccttcatctatcctccatcacccatccttccatccatagtcatacatccttgcatccatccatcaatcttccatcatctgtctttctatctatattcataaatctattcatccatccatccacccacccatatccatcatccatctatccatctatattcacacatccatctttccatctgttatccatccatccaacaaacatctgtttaccatccatccatctattcatacgtcccatctgtccatgcattcattatccagccagccgtccgtcactctgcagatccttgttttatcctgtctgtctcttaatgcaatcatcccatcagccctggtcttgccctattcaaggtctccctgtctgtctagccttgagtctcatcccttccccgtgtttcccctcctccttctcccgacagcgttgctgctctccaatccagcctaccgcctccttctggccacttacgcccgtccccctcgaggcccgggcccccccacacccgcctgggccaaacccaccaacacccagggtaagcccctctgcccctgggctccgccaggctccccatacctctactggggcagggaaaagccctcacaccttgcacttcctcctctccccactgtggcctattctgctctcctgagctcccaaggaggaagctcttgtgcccttagctcatctctgctgctgcttgctcttttttaaggtcccccccttgagctgaggagtagaaagcttactggtccccagctcttctccctcctcctcttccacgccatctcttcagctctccagagctagacaggaggttgctgtggtggccccagactatagtaactcctcctttattctccactctctctagagctgcgaggaggagggctctcaccccgggcgcttgccctttccctcacatgtgtcctctctctgcagtcccagaggtgaaggctcatgccccaaccctttccatctgcccctcttctcctcagtgttgccttctcattgtggccccttccccagggctaagaggggacagctctgcttcctctcctgtctgtagacaacttgtgttggggctgtgagcagctgttaccctccctcctctctgtgtgcctctgtctctgcttgttgttgagcttggtgtgttgggttgaaagggttgggagggcttggccccagggggagccaggctgaaagccacgggagagcagctaagtgaaggggagggagctgtggtgaacgggacaagggtttggaaggtggagggtgcctggatgctgggaccatcctgaggcgggagaattcctggggaggaattcttcttccagccaagatttatctcacagtctcttgagagaccctagggaggccctaaaagagtaagactttatgacagttttgctcaaccatattcattgccttgaaaagctctggaatagctaactctcgtcccatgccagtgtcttcctggtttgaggttggcgcatggaatactgggaagatacagcatagacccagtctctcactcaaccgggagacacagggccctccgggaggctgaggtgtggggaactatagctcttgggctgttcctgatgcctcgtcctgtcttctttcccctcacccctgcagcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtaaggagggtgcctacccagtgtctggccctattgtgtgctctgatgccatgcctgcgcatccccctagccaggaaccttagtcatttgtaaccgtgttaatccgtttgaccctgtgaccgcctagcaaacgaacttctttctccaggtgcacctgtgtgaggtcgacagccctcaagatctggttagtcttgatttcccccttaatgtgcgtaagggacaccctttgctggtagctgtcaagatcttacggccagatgccaccaagaatgccaggtgaggaccagggatggcatctggaagaagggaggggaggccgcgaagagtggcgagccatctagagagaacaatggcagagcccaacagaggggtggtatctctgggaggggatttacatgtacgctgggggtggggacgcctggtctgcctgaggtggcgcaggggggtggnggcgctgcggaaggtgtaggccgnccactcggcattcctcttcagcttctcctttgttctccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcaggtacctgtttacccaggctgggccatgctcagaattcccccaggggatctcctcctctcccctcgcttcagcctgggggaaaagaggggagcgtgggggtgggaagggagagaggttccaggagggcctgggataaggaatgtgtgacaagttaacccaggaatatggacagaaaggctggaggtgactatgcaagagtggtgaagggacttgggccctgccatgacgtcccttctgctttctctcaccctcactcccctctgagtccagattggggagcacaataaaagaagagccccctagtgttggccaggcctgggagattgagagagaagtgacccttggcctcacgtgggcattccacctccacatggggagccagagtgaccgggcccggggagtgggctctctctcctctcctggatgggaatctgcgaagctgcccccagtgaccttctgtcggttcccttctcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggtgagcagcccgaggacagccaggttggagcagggcaggtgggagaacactggccgccactcacagccctggtctccatcagtcacacactttctctgggttgcatttacagaatctcatctataatatgaggttctcctagcccaagggactggggaaagcaggagccgcagtgtgatgggcaagaatccaggagccaagagtgggtactggggatggagacagcgtggcagagagctcaagagatgaggttgggggaggaagctggagatagaaggggttgggtagggagaccgaaggtcaggaccagaaagtgggggttgggtggagaggaaggaggagcagaaggaagaggttggtccagggccccctggagagaggaaccagattcatggagacgganaagccagagccccaagggagaggagttggnaaaaggtgcccaccggaggagagtggagagcctgncntcaggagggatcagncctgagtggagcccagagtggatctggggcttccaataggaagggaggggggtcaaccgttgcctgatgtcccctgtctgtttttgctgccttcctctgcatcccaggggaagttcacgactgcgagtgacgtgtgggcctttggtgtgaccgtgtgggaggtgctgatgctctgtagggcccagccctttgggcagctcaccgacgagcaggtcatcgagaacgcgggggagttcttccgggaccagggccggcaggtcagagtggaggagagggaagatgggtccgagncgggggacagaaggggcagagttttcatcttggagactaaagaataattgttccctgactctcaaccacacttccncaatncaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgccccttcccctcccgacagcccatcacctctaatagaggcagtgagactgcaggctgggcccacccagggagctgatgccccttctccccttcctggacacactctcatgtccccttcctgttcttccttcctagaagcccctgtcgcccacccagctggtcctgtggatgggatcctctccacccacctctagccatcccttggggaagggtggggagaaatataggatagacactggacatggcccattggagcacctgggccccactggacaacactgattcctggacaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcaccccccacttcccacctgcagtcttgtagctagaacttctctaagcctatacgtttctgtggagtaaatattgggattggggggaaagagggagcaacggcccatagccttggggttggacatctctagtgtagctgccacattgatttttctataatcacttgggtttgtacatttttggggggagagacacagatttttacactaatatatggacctagcttgaggcaattttaatcccctgcactaggcaggtaataataaaggttgagttttccac

SEQ ID NO: 2 - DNA, 987 bp, Homo sapiens
ccgggatctgctttcaatccgccatcccatggagcatggcatcgtcaaggattggaacgacatggaacgcatttggcaatatgtctattctaaggaccagctgcagactttctcagaggagcatcctgtgctcctgactgaggcgcctttmaacccacgaaaaaaccgggaacgagctgccgaagttttcttcgagaccttcaatgtgcccgctcttttcatctccatgcmagcygtactcagcctttacgctacaggcaggaccacaggggtggtgctggattctggggatggrgtcacccatgctgtgcccatctatgagggctttgccatgccccactccatcatgcgcatcgacatcgcgggccgggacgtctctcgcttcctgcgcctctacctgcgtaaggagggctacgacttccactcatcctctgagtttgagattgtcaaggccataaaagaaagagcctgttacctatccataaacccccaaaaggatgagacgctagagacagagaaagctcagtactacctgcctgatggcagcaccattgagattggtccttcccgattccgggcccctgagttgctcttcaggccagatttgattggagaggagagtgaaggcatccacgaggtcctggtgttcgccattcagaagtcagacatggacctgcggcgcacgctttttctctaacattgtcctctcaggaggctctaccctgttcaaaggttttggtgacaggctcctgagtgaagtgaagaaactagctccaaaagatgtgaagatcaggatatctgcacctcaggagagactgtattccacgtggattgggggctccatccttgcctccctggacacctttaagaagatgtgggtctccaaaaaggaatatgaggaagatggtgcccgatccatccacagaaaaaccttctaatgtcgggacatcatcttcacctctctctgaagttaactccactttaaaa

SEQ ID NO: 3 - DNA, 2808 bp, Homo sapiens
ggaaagcacctgtgagcttggcaagtcagttcagagctccagcccgctccagcccggcccgacccgaccgcacccggcgcctgcctcgctcgggctccccggccagccatgggcccttggagccgcagcctctcgggcctgctgctgctgctgaggtctcctcttggctctcaggagcggagccctcctccctgtttgacgcgagagctacacgttcacggtgccccggcgccacctgagaagaggccgcgtctgggcagagtgaattttgaagattgcaccggtcgacaaaggacagctattttcctgacaccgattccgaaagtgggcacagatggtgtgattacagtcaaaaggcctctacggtttcataacccaacagatccatttcttggtctacgctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgtacaagggtcaggtgcctgagaacgaggctaacgtcgtaatcaccacactgaaagtgactgatgctgatgcccccaataccccagcgtgggaggctgtatacaccatattgaatgatgatggtggacaatttgtcgtcaccacaaatccagtgaacaacgatggcattttgaaaacagcaaagggcttggattttgaggccaagcagcagtacattctacacgtagcagtgacgaatgtggtaccttttgaggtctctctcaccacctccacagccaccgtcaccgtggatgtgctggatgtgaatgaaggccccatctttgtgcctcctgaaaagagagtggaagtgtccgaggactttggcgtgggccaggaaatcacatcctacactgcccaggagccagacacatttatggaacagaaaataacatatcggatttggagagacactcgcaactggctggagattaatccggacactggtgccatttccactcgggctgagctggacagggaggattttgagcacgtgaagaacagcacgtacacagccctaatcatagctacagacaatggttctccagttgctactggaacagggacacttctgctgatcctgtctgatgtgaatgacaacgcccccataccagaacctcgaactatattcttctgtgagaggaatccaaagcctcaggtcataaacattcatgatgcagaccttcctcccaatacatctcccttcacagcagaactaacacacgggcgagtgcccaactggaccattcagtacaacgacccaacccaagaatctatcattttgaagccaaagatggccttagaggtgggtgactacaaaatcaatctcaagctcatggataaccagaataaagaccaagtgaccaccttagaggtcagcgtgtgtgactgtgaaggggccgccggcgtctgtaggaaggcacagcctgtcgaagcaggattgcaaattcctgccattctggggattcttggaggaattcttgctttgctaattctgattctgctgctcttgctgtttcttcggaggagagcggtggtcaaagagcccttactgcccccagaggatgacacccgggacaacgtttattactatgatgaagaaggaggcggagaagaggaccaggactttgacttgagccagctgcacaggggcctggacgctcggcctgaagtgactcgtaacgacgttgcaccaaccctcatgagtgtcccccggtatcttccccgccctgccaatcccgatgaaattggaaattttattgatgaaaatctgaaagcggctgatactgaccccacagccccgccttatgattctctgctcgtgtttgactatgaaggaagcggttccgaagctgctagtctgagctccctgaactcctcagagtcagacaaagaccaggactatgactacttgaacgaatggggcaatccgttcaagaagctggctgacatgtacggaggcggcgaggaccactaggggactcgagagaggcggcccagaccatgtgcagaaatgcagaaatcagcgttctggtgtttt

SEQ ID NO: 4 - DNA, 1478 bp, Homo sapiens
gtgagacagcagtgaagccgccggcacctccgctgccgcagatgatggaagggaacgggaacggccatgagcactgcagcgattgcgagaatgaggaggacaacagctacaaccggggtggtttgagtccagccaatgacactggagccaaaaagaagaaaaagaaacaaaaaaagaagaaagaaaaaggcagtgagacagattcagcccaggatcagcctgtgaagatgaactctttgccagcagagaggatccaggaaatacagaaggccattgagctgttctcagtgggtcagggacctgccaaaaccatggaggaggctagcaagcgaagctaccagttctgggatacgcagcccgtccccaagctgggcgaagtggtgaacacccatggccccgtggagcctgacaaggacaatatccgccaggagccctacaccctgccccagggcttcacctgggatgctttggacttgggcgatcgtggtgtgctaaaagaactgtacaccctcctgaatgagaactatgtggaagatgatgacaacatgttccgatttgattattccccggagtttcttttgtgggctctccggccacccggctggctcccccagtggcactgtggggttcgagtggtctcaagtcggaaattggttgggttcattagcgccatcccagcaaacatccatatctatgacacagagaagaagatggtagagatcaacttcctgtgtgtccacaagaagctgcgttccaagagggttgctccagttctgatccgagagatcaccaggcgggttcacctggagggcatcttccaagcagtttacactgccggggtggtactaccaaagcccgttggcacctgcaggtattggcatcggtccctaaacccacggaagctgattgaagtgaagttctcccacctgagcagaaatatgaccatgcagcgcaccatgaagctctaccgactgccagagactcccaagacagctgggctgcgaccaatggaaacaaaggacattccagtagtgcaccagctcctcaccaggtacttgaagcaatttcaccttacgcccgtcatgagccaggaggaggtggagcactggttctacccccaggagaatatcatcgacactttcgtggtggagaacgcaaacggagaggtgacagatttcctgagcttttatacgctgccctccaccatcatgaaccatccaacccacaagagtctcaaagctgcttattctttctacaacgttcacacccagacccctcttctagacctcatgagcgacgcccttgtcctcgccaaaatgaaagggtttgatgtgttcaatgcactggatctcatggagaacaaaaccttcctggagaagctcaagtttggcataggggacggcaacctgcagtattacctttacaattggaaatgccccagcatgggggcagagaaggttggactggtgctacaataa

SEQ ID NO: 5 - DNA, 1846 bp, Homo sapiens
aaaagtgcctttgttggcctgggctcaggaatccagagaaactggtcaggaggaggccccagtgacaaaaacccctccctctgcccccgcccctctgccagagccatataactgctcaacctgtccccgagagagagtgccctggcagctgtcggctggaaggaactggtctgctcacacttgctggcttgcgcatcaggactggctttatctcctgactcacggtgcaaaggtgcactctgcgaacgttaagtccgtccccagcgcttggaatcctacggcccccacagccggatcccctcagccttccaggtcctcaactcccgtggacgctgaacaatggcctccatggggctacaggtaatgggcatcgcgctggccgtcctgggctggctggccgtcatgctgtgctgcgcgctgcccatgtggcgcgtgacggccttcatcggcagcaacattgtcacctcgcagaccatctgggagggcctatggatgaactgcgtggtgcagagcaccggccagatgcagtgcaaggtgtacgactcgctgctggcactgccgcaggacctgcaggcggcccgcgccctcgtcatcatcagcatcatcgtggctgctctgggcgtgctgctgtccgtggtggggggcaagtgtaccaactgcctggaggatgaaagcgccaaggccaagaccatgatcgtggcgggcgtggtgttcctgttggccggccttatggtgatagtgccggtgtcctggacggcccacaacatcatccaagacttctacaatccgctggtggcctccgggcagaagcgggagatgggtgcctcgctctacgtcggctgggccgcctccggcctgctgctccttggcggggggctgctttgctgcaactgtccaccccgcacagacaagccttactccgccaagtattctgctgcccgctctgctgctgccagcaactacgtgtaaggtgccacggctccactctgttcctctctgctttgttcttccctggactgagctcagcgcaggctgtgaccccaggagggccctgccacgggccactggctgctggggactggggactgggcagagactgagccaggcaggaaggcagcagccttcagcctctctggcccactcggacaacttcccaaggccgcctcctgctagcaagaacagagtccaccctcctctggatattggggagggacggaagtgacagggtgtggtggtggagtggggagctggcttctgctggccaggatagcttaaccctgactttgggatctgcctgcatcggcgttggccactgtccccatttacattttccccactctgtctgcctgcatctcctctgttccgggtaggccttgatatcacctctgggactgtgccttgctcaccgaaacccgcgcccaggagtatggctgaggccttgcccacccacctgcctgggaagtgcagagtggatggacgggtttagaggggaggggcgaaggtgctgtaaacaggtttgggcagtggtgggggagggggccagagaggcggctcaggttgcccagctctgtggcctcaggactctctgcctcacccgcttcagcccagggcccctggagactgatcccctctgagtcctctgccccttccaaggacactaatgagcctgggagggtggcagggaggaggggacagcttcacccttggaagtcctggggtttttcctcttccttctttgtggtttctgttttgtaatttaagaagagctattcatcactgtaattattattattttctacaataaatgggacctgtgcacaggaaaaaaaaaaaaaaaaaaaaaaaa

SEQ ID NO: 6 - DNA, 585 bp, Homo sapiens
  misc_feature (1)..(585): n = a,c,t, or g
ttccttgggcttctccttctccttgagcgcttcggcctcctccttctcctcctcagcctggccgctctctgactccgactcagactctgacacgctgccctcgtcaaagctgtcgtcaccactgtgcttccggttccgcttcttgctactctttttggcttccttctcggagtcttctttcttctcttccttgtccccatcaccctccgacttctttgttttgtcatcattagaactgtcattctcagcctgcttgccgtcttccttcttctcatccttgtcgttggttttgcgctccccgtcccctaggcctgctccagcccgtccttcttctttcttgctgggctccccaggctttcctgcctgctcctcctcctcctcctgctccaggatgcgaagatcattctccgtgcctccttccatcttaatcacggctgcatccagcatcttgacaatggcatcagctntgtctatgtccaggagaaggttatcaaaccagccagtctccatgagggacaggaagaccctcagtcgggtttgcagggccccccgggcctnctgccgacgcttccccacctcatctgg

SEQ ID NO: 7 - DNA, 2982 bp, Homo sapiens
gcctcggaggcgtgggtgacgcaggcgcagcgcgggctgcgcgcgctactgcccatccccggttgtcccacttttgttcgcctctcttcggccctctactcaagagctccgtctccgtctcgccctcctcgaagtcctcgtcgcgcgcccgcgacccaggtcgccctgaaatctagcccgtccgagcgcgagtccaacgccgcggccgcaccaaggccccctcagaccgtgccatgggtgacagtgatgacgagtacgatcgaaggcgcagggacaagttcagaagagagcgcagcgactacgaccgttcccgcgagagagatgaaagacgtcgaggggacgattggaatgacagagagtgggaccgtggccgtgagcgccgtagtcggggtgaatatcgggactatgaccggaatcggcgagagcgcttctcgccacctcgccacgaactcagcccgccacagaagcgcatgaggagagactgggatgagcacagctctgacccataccacagtggctatgagatgccctatgctggggggggtgggggcccaacttatggcccccctcagccctggggccaccctgacgtccacatcatgcagcaccatgtcctgcctatccaggccaggctgggcagcattgcagagattgacctgggtgtgccgccgcccgtgatgaagaccttcaaggagtttctcctctccctggatgactcggtggatgagacggaggccgtcaagcgctataatgactacaagctggatttccggaggcaacagatgcaggatttcttcctggcgcacaaagatgaggagtggtttcggtctaagtaccacccagatgaggtggggaagcgtcggcaggaggcccggggggccctgcaaaaccgactgagggtcttcctgtccctcatggagactggctggtttgataaccttctcctggacatagacaaagctgatgccattgtcaagatgctggatgcagccgtgattaagatggaaggaggcacggagaatgatcttcgcatcctggagcaggaggaggaggaggagcaggcaggaaagcctggggagcccagcaagaaagaagaaggacgggctggagcaggcctaggggacggggagcgcaaaaccaacgacaaggatgagaagaaggaagacggcaagcaggctgagaatgacagttctaatgatgacaaaacaaagaagtcggagggtgatggggacaaggaagagaagaaagaagactccgagaaggaagccaaaaagagtagcaagaagcggaaccggaagcacagtggtgacgacagctttgacgagggcagcgtgtcagagtctgagtcggagtcagagagcggccaggctgaggaggagaaggaggaggccgaagcgctcaaggagaaggagaagcccaaggaagaagaatgggagaagcccaaggacgccgcggggctggagtgcaagccgcggccgctgcataagacctgctccctcttcatgcgcaacatcgcgcccaacatctcccgggccgagatcatctccctttgtaaaaggtacccaggctttatgcgggtggcgctctcagagccccagccagagaggaggtttttccgtcgtggctgggtgaccttcgaccgcagtgttaacattaaagagatctgttggaacctgcagaacatccgtctccgggagtgtgagctgagccctggtgtgaacagggacctgacccggcgcgttcgcaacatcaacggcatcacccagcacaagcagattgtgcgcaacgacatcaagctggcggccaagctgatccacacgctggatgacaggacacagctttgggcctcagaaccagggacgcctcccctgcccacgagcctgccctcgcaaaacccgatcttgaagaatatcaccgactacctgatcgaggaagtaagcgccgaggaggaggagctgctggggagcagcgggggcgctcctcctgaggagcctcctaaggaagggaacccggcagagatcaacgtggagcgggatgagaagttgattaaggtcttggacaagctcctcctttacctgcgcatcgtgcattccttggattattacaacacctgtgagtaccccaacgaggacgagatgcccaatcgctgtgggatcatccacgttcgggggcccatgccacccaaccgcatcagtcacggggaagtgctggagtggcagaagacttttgaggagaagctcacgccgttgctgagtgtgcgggagtcactctcagaggaagaggcccagaagatggggcgcaaagacccagagcaggaagtggagaagttcgtcacctccaacacgcaggaactgggcaaggataagtggctgtgtcctctcagtggcaagaaattcaagggtcctgagtttgtgcgcaaacatatcttcaacaagcatgcagagaaaattgaggaagtgaaaaaggaagtcgcgttttttaacaacttcctcactgatgctaagcgcccagctctgcctgagatcaagccagcccagccacctggccccgcccagatactccccccaggtttgaccccaggactcccctacccacaccagactccccagggcctgatgccctatggtcagccccggcccccgatcttgggctatggagctggtgctgtccgccctgcagtccccacaggaggccctccatacccccatgccccgtatggtgctggtcgagggaactatgatgccttccgaggccagggaggttatcctgggaaacctcgcaacaggatggttcgtggagacccaagggccattgtggaatatcgggacctggatgccccagacgatgttgatttcttttgagccgtcccccgttcctcagtcctgtatcatccatacttgtactaccttgtcctatgaagctctgagaattttttgtacgatcagccttactgctaataaaagcacttccacagggaaaaaa

SEQ ID NO: 8 - DNA, 447 bp, Homo sapiens
ccaaaaatactccaggctctttctcttataagtcatttttttttctcctgtaaaaagcccccctgccctgccttcttacataaagcacttactacgcgccaaagtgcccttgagacctaagatctgaagcaactatgagaaaggtacagagggagagagagagagaaagagagcacgccagtgagaaagcgagcgcgagcgcgagcgcaaggggaggagagggtgggagagggcggaagggggaaagctgtccgtgggagattgtgtcttcatgtccacggggctgcatctcttgatggtgcactgaaaaagcagagctcaccagacagagtggaaaggcagggggaggggcagggagcaacagaaggaagagacaacaagcccaagacagcttccatctcagacggaaggcccccagaagatagaattccagccgactgaaaaacc

SEQ ID NO: 9 - DNA, 539 bp, Homo sapiens
cctaacaattccgacatggttcacattcatcaagactaaagccatccctcgggagagaccctggctaccgacattcatgtgaagattgtctagtgaattgcttgcgacacatcccaccatcgccatcccacagttgttactggtttgtcaagcataagccatgccctaacgacaggctggcctttgacagcagatgttctacagagatgagtgcatttttatttgggtggggtagagatggtgtcttttggaccccaacaaactgtactctaaacttcacagagtccttgggacgggaaatcatcacctcatccagggacactggctatcttcaaagatgggtgcggcgactccacatcactgtgaccttctttgctaagtgtttcggaaacagaacacgaataaaatactcatctcagaaccagagcactttttggtcttctgggacatgaataattcacatacccaagtggaggccaatcaatgatctgagaatgatcaacgcaccctggcttttgcaggtggtcctggcacgttcc

SEQ ID NO: 10 - DNA, 3504 bp, Homo sapiens
ctcccacggtctctagttcgcgttatggccgctgccgcggctgtggaggcggcggcgcctatgggtgccctatggggcctcgtgcacgacttcgtcgtgggtcagcaagagggccccgctgaccaggtggctgcagatgtgaaatctggcaactatacagtgttacaagttgtggaagcccttgggtcctctctagagaatccagaaccccgaactcgggcacgaggaatccagcttttgtcacaggtgctactccactgtcacaccttgctcctggagaaggaagtggtacacctgatactgttctatgagaaccggctgaaggaccatcatcttgtgatcccatctgtcctgcagggtttgaaggcacttagcctgtgtgtggccctgcccccagggctggctgtttctgtgcttaaagccatcttccaggaagtgcatgtacagtccctgccacaggtggaccgacacacagtctacaatatcatcaccaattttatgcgaacccgggaagaagagctaaagagcctaggagctgacttcacctttggcttcatccatgtgatggatggggaaaaggatccccgtaatcttctggtggccttccgcatcgtccatgacctcatctccagggactatagcctgggaccctttgtggaggagttgtttgaagtgacatcctgttatttccctatcgattttacccctccacctaatgatccccatggtatccagagagaagacctcatcctgagtcttcgcgctgtgctggcttctacaccacgatttgctgagtttctgctgcccctgttgattgagaaagtggattctgaggttctgagtgccaagttggattctctacagactctgaatgcttgctgtgctgtgtatggacagaaggaactgaaggacttcctccccagcctttgggcttctatccgcagagaggtgttccagacggcaagtgagcgggtggaggcagagggcctggcggccctccactccctgactgcgtgtttgtctcgctctgtgctgagggctgatgctgaggacctccttgactccttccttagcaacattctacaggactgcagacaccacctgtgtgaaccggacatgaaactggtgtggcctagtgccaagctgttgcaggcagctgcaggtgcatctgcccgggcctgtgactctgacaccagcaatgtaccgcctttactgctggaacagttccacaagcacagtcagagcagccagcggcggacaatccttgaaatgctcctgggtttcttgaagctgcagcagaaatggagctatgaagacaaagatcaaaggcctctgaatggcttcaaggaccagctgtgctcactggtattcatggctctaacagaccccagcacccagcttcagcttgttggcatccgtacactgacagtcttgggtgcccagccagatctcctatcttatgaggacttggagctggcagtgggtcacctgtacagactgagcttcctgaaggaggattcccagagttgcagggtggcagcactggaagcatcaggaaccctggctgctctctaccctgtggccttcagcagccacctcgtacccaagctcgctgaggagctgcgtgtaggggagtcaaatttgactaacggagatgagcccacccaatgctcccggcatctgtgctgtctgcaagccttgtcagctgtatcaacacatcccagcatcgtcaaggagacactgcctctgctgctgcagcatctctggcaagtgaacagagggaatatggttgcacaatccagtgacgttattgctgtctgtcagagcctcagacagatggcagaaaaatgtcagcaggaccctgagagttgctggtatttccaccagacagctataccttgcctgcttgccttggctgtgcaggcctctatgccagagaaggagccctcagttctgagaaaagtactattggaggatgaggtgttggctgccatggtgtctgtcattggcactgctacaacccacctgagccctgagttagctgcccagagtgtgacacacattgtgcccctcttcttggatggcaacgtgtcctttctgcctgaaaacagcttcccgagcagattccagccattccaggatggctcctcagggcagaggcggctgattgcactgcttatggcctttgtctgctccctgcctcgaaatgtggaaatccctcagctgaaccaactcatgcgggagtttttggaactgagctgctgccacagctgccccttttcttccaccgctgctgccaagtgctttgcaggactcctcaacaagcaccctgcagggcagcagctggatgaattcctacagctagctgtggacaaagtggaggctggcctgggctctgggccttgtcgtagtcaggccttcactcttcttctctgggtaacaaaggccctagtgctcagataccatcctctcagctcctgccttacagcccggctcatgggcctcctgagtgacccagaattaggtccagcagcagctgatggcttctctctgctcatgtctgactgcactgatgtgctgactcgtgctggccatgccgaagtgcggatcatgttccgccagcggttcttcacagataatgtgcctgctttggtccagggcttccatgctgctccccaagatgtgaagccaaactacttgaagggtctttctcatgtacttaacaggctgcccaagcctgtactcttgccagagctgcccacgcttctttccttgctgctggaggccctgtcctgccctgactgtgtggtgcagctctccaccctcagctgccttcagcctcttctactggaagcaccccaagtcatgagtcttcacgtggacaccctcgtcaccaagtttctgaacctcagctctagcccttccatggctgtccggatcgccgcactgcagtgcatgcatgctctcactcgcctgcccacccctgtgctgctgccgtacaaaccacaggtgattcgggccttagccaaacccctggatgacaagaagagactggtgcgcaaggaagcagtgtcagccagaggggagtggtttctgttggggagccctggcagctgagccctcagtcctggcctagactgttctgacaatctaacctgggattactaactgttgagccatcttccccaaagcagggaaaccactggtctctgactgcctttcccacagacacagcacaaatgctaggcctctgttgcatggctgtacaaagaacataagagtccatatttctagtggatttgtaaaataagtgtgtgtgagacacttgcgtttgaagaaagatctagggtcctgggtctcttgcatttatatgtcagaaaaggggcgatatgctgctgaggggtgagtgcatatgagtgtggccctgaggaccagggctggcagatgttgtctacctgctgaagaataaagatttcttttggtaaaaaaaaaaaaaaaaaaaaa

SEQ ID NO: 11 - DNA, 1700 bp, Homo sapiens
ggcggcggcagcgggttcggttgcgcgtggcgcacggggtgggagcggagcccaggccgggagcaggcgccgccgccagcgaccatggggaacgtgttggctgccagctcgccgcccgcagggccgccaccgccgcctgcgccggccctcgtggggctgccgccacctccgccctcgccgccgggcttcacgctgccgccgctgggaggcagcctgggcgccggcaccagtacgagtcgaagttcggaacggacccccggggctgcaaccgccagcgcctcaggggccgccgaggatggggcctgcggctgcctgcccaacccgggcacattcgaggagtgccaccggaagtgcaaggagctgtttcccattcagatggagggtgtcaagctcacagtcaacaaagggttgagtaaccattttcaggtcaaccacacagtagccctcagcacaatcggggagtccaactaccacttcggggtcacatatgtggggacaaagcagctgagtcccacagaggcgttccctgtactggtgggtgacatggacaacagtggcagtctcaacgctcaggtcattcaccagctgggccccggtctcaggtccaagatggccatccagacccagcagtcgaagtttgtgaactggcaggtggacggggagtatcggggctctgacttcacagcagccgtcaccctggggaacccagacgtcctcgtgggttcaggaatcctcgtagcccactacctccagagcatcacgccttgcctggccctgggtggagagctggtctaccaccggcggcctggagaggagggcactgtcatgtctctagctgggaaatacacattgaacaactggttggcaacggtaacgttgggccaggcgggcatgcacgcaacatactaccacaaagccagtgaccagctgcaggtgggtgtggagtttgaggccagcacaaggatgcaggacaccagcgtctccttcgggtaccagctggacctgcccaaggccaacctcctcttcaaaggctctgtggatagcaactggatcgtgggtgccacgctggagaagaagctcccacccctgcccctgacactggcccttggggccttcctgaatcaccgcaagaacaagtttcagtgtggctttggcctcaccatcggctgagccctcctggcccccgccttccacgcccttccgattccacctccacctccacctccccctgccacagaggggagacctgagcccccctcccttccctccccccttgggggtcggggggggacattggaaaggagggaccccgccaccccagcagctgaggaggggattctggaactgaatggcgcttcgggattctgagtagcaggggcagcatgcccagtgggcctggggtcccgggagggattccggaattgaggggcacgcaggattctgagcaccaggggcagaggcggccagacaacctcagggaggagtgtcctggcgtccccatcctccaaagggcctgggcccgccccgagggggcagcgagaggagcttccccatccccggtcagtccaccctgccccgtccactttcccatctcctcggtataaatcatgtttataagttatggaagaaccgggacattttacagaaaaaaaacaaaaaacaacaaaaaatatacgtgggaaaaaaaaaaaaaaaaaaaa

SEQ ID NO: 12 - DNA, 2259 bp, Homo sapiens
gttctccccttcccggctttcggtccggaggaggcgggagcagcttccctgttctgatcctatcgcgggcggcgcagggccggcttggccttccgtgggacggggaggggggcgggatgtgtcacccaaataccagtggggacggtcggtggtggaaccagccgggcaggtcgggtagagtataagagccggagggagcggccgggcggcagacgcctgcagaccatcccagacgccggagcccgagccccgccgagtccccgcgcctcatccgcccgcgtccggtccgcgttcctccgccccaccatggctcggggccccggcctcgcgccgccaccgctgcggctgccgctgctgctgctggtgctggcggcggtgaccggccacacggccgcgcaggacaactgcacgtgtcccaccaacaagatgaccgtgtgcagccccgacggccccggcggccgctgccagtgccgcgcgctgggctcgggcatggcggtcgactgctccacgctgacctccaagtgtctgctgctcaaggcgcgcatgagcgcccccaagaacgcccgcacgctggtgcggccgagtgagcacgcgctcgtggacaacgatggcctctacgaccccgactgcgaccccgagggccgcttcaaggcgcgccagtgcaaccagacgtcggtgtgctggtgcgtgaactcggtgggcgtgcgccgcacggacaagggcgacctgagcctacgctgcgatgacctggtgcgcacccaccacatcctcattgacctgcgccaccgccccaccgccggcgccttcaaccactcagacctggacgccgagctgaggcggctcttccgcgagcgctatcggctgcaccccaagttcgtggcggccgtgcactacgagcagcccaccatccagatcgagctgcggcagaacacgtctcagaaggccgccggtgaagtggatatcggcgatgccgcctactacttcgagagggacatcaagggcgagtctctattccagggccgcggcggcctggacttgcgcgtgcgcggagaacccctgcaggtggagcgcacgctcatctattacctggacgagattcccccgaagttctccatgaagcgcctcaccgccggcctcatcgccgtcatcgtggtggtcgtggtggccctcgtcgccggcatggccgtcctggtgatcaccaaccggagaaagtcggggaagtacaagaaggtggagatcaaggaactgggggagttgagaaaggaaccgagcttgtaggtacccggcggggcaggggatggggtggggtaccggatttcggtatcgtcccagacccaagtgagtcacgcttcctgattcctcggcgcaaaggagacgtttatcctttcaaattcctgccttccccctcccttttgcgcacacaccaggtttaatagatcctggcctcagggtctcctttctttctcacttctgtcttgaaggaagcatttctaaaatgtatcccctttcggtccaacaacaggaaacctgactggggcagtgaaggaagggatggcacagcgttatgtgtaaaaaacaagtatctgtatgacaacccgggatcgtttgcaagtaactgaatccattgcgacattgtgaaggcttaaatgagtttagatgggaaatagcgttgttatcgccttgggtttaaattatttgatgagttccacttgtatcatggcctacccgaggagaagaggagtttgttaactgggcctatgtagtagcctcatttaccatcgtttgtattactgaccacatatgcttgtcactgggaaagaagcctgtttcagctgcctgaacgcagtttggatgtctttgaggacagacattgcccggaaactcagtctatttattcttcagcttgcccttactaccactgatattggtaatgttcttttttgtaaaatgtttgtacatatgttgtctttgataatgttgctgtaattttttaaaataaaacacgaatttaataaaatatgggaaaggcacaaaccagaagttggcatttgtgaaaagtccctccagatttctatcactttggtctctaatttcccaagacttgtattttttttttatttcaaattataacacttttttttcccccagaagtgggtgtttcatgttgctactctggtgtgtcccaagatatcctaactggccagtgtaaatgctattctttctaaataagattatttggaaacttccttcaaactgcag

SEQ ID NO: 13 - DNA, 14135 bp, Homo sapiens
gcactgcagcgccagcgtccgagcgggcggccgagctcccggagcggcctggccccgagccccgagcgggcgtcgctcagcagcaggtcgcggccgcagccccatccagccccgcgcccgccatgccgtccgcgggccccgcctgagctgcggcctccgcgcgcgggcgggcctggggacggcggggccatgcgcgcgctgccctaacgatgccgcccgccgcgcccgcccgcctggcgctggccctgggcctgggcctgtggctcggggcgctggcggggggccccgggcgcggctgcgggccctgcgagcccccctgcctctgcggcccagcgcccggcgccgcctgccgcgtcaactgctcgggccgcgggctgcggacgctcggtcccgcgctgcgcatccccgcggacgccacagcgctagacgtctcccacaacctgctccgggcgctggacgttgggctcctggcgaacctctcggcgctggcagagctggatataagcaacaacaagatttctacgttagaagaaggaatatttgctaatttatttaatttaagtgaaataaacctgagtgggaacccgtttgagtgtgactgtggcctggcgtggctgccgcgatgggcggaggagcagcaggtgcgggtggtgcagcccgaggcagccacgtgtgctgggcctggctccctggctggccagcctctgcttggcatccccttgctggacagtggctgtggtgaggagtatgtcgcctgcctccctgacaacagctcaggcaccgtggcagcagtgtccttttcagctgcccacgaaggcctgcttcagccagaggcctgcagcgccttctgcttctccaccggccagggcctcgcagccctctcggagcagggctggtgcctgtgtggggcggcccagccctccagtgcctcctttgcctgcctgtccctctgctccggccccccgccacctcctgcccccacctgtaggggccccaccctcctccagcacgtcttccctgcctccccaggggccaccctggtggggccccacggacctctggcctctggccagctagcagccttccacatcgctgccccgctccctgtcactgccacacgctgggacttcggagacggctccgccgaggtggatgccgctgggccggctgcctcgcatcgctatgtgctgcctgggcgctatcacgtgacggccgtgctggccctgggggccggctcagccctgctggggacagacgtgcaggtggaagcggcacctgccgccctggagctcgtgtgcccgtcctcggtgcagagtgacgagagcctcgacctcagcatccagaaccgcggtggttcaggcctggaggccgcctacagcatcgtggccctgggcgaggagccggcccgagcggtgcacccgctctgcccctcggacacggagatcttccctggcaacgggcactgctaccgcctggtggtggagaaggcggcctggctgcaggcgcaggagcagtgtcaggcctgggccggggccgccctggcaatggtggacagtcccgccgtgcagcgcttcctggtctcccgggtcaccaggtgcctagacgtgtggatcggcttctcgactgtgcagggggtggaggtgggcccagcgccgcagggcgaggccttcagcctggagagctgccagaactggctgcccggggagccacacccagccacagccgagcactgcgtccggctcgggcccaccgggtggtgtaacaccgacctgtgctcagcgccgcacagctacgtctgcgagctgcagcccggaggcccagtgcaggatgccgagaacctcctcgtgggagcgcccagtggggacctgcagggacccctgacgcctctggcacagcaggacggcctctcagccccgcacgagcccgtggaggtcatggtattcccgggcctgcgtctgagccgtgaagccttcctcaccacggccgaatttgggacccaggagctccggcggcccgcccagctgcggctgcaggtgtaccggctcctcagcacagcagggaccccggagaacggcagcgagcctgagagcaggtccccggacaacaggacccagctggcccccgcgtgcatgccagggggacgctggtgccctggagccaacatctgcttgccgctggacgcctcctgccacccccaggcctgcgccaatggctgcacgtcagggccagggctacccggggccccctatgcgctatggagagagttcctcttctccgttcccgcggggccccccgcgcagtactcggtcaccctccacggccaggatgtcctcatgctccctggtgacctcgttggcttgcagcacgacgctggccctggcgccctcctgcactgctcgccggctcccggccaccctggtccccgggccccgtacctctccgccaacgcctcgtcatggctgccccacttgccagcccagctggagggcacttgggcctgccctgcctgtgccctgcggctgcttgcagccacggaacagctcaccgtgctgctgggcttgaggcccaaccctggactgcggctgcctgggcgctatgaggtccgggcagaggtgggcaatggcgtgtccaggcacaacctctcctgcagctttgacgtggtctccccagtggctgggctgcgggtcatctaccctgccccccgcgacggccgcctctacgtgcccaccaacggctcagccttggtgctccaggtggactctggtgccaacgccacggccacggctcgctggcctgggggcagtgtcagcgcccgctttgagaatgtctgccctgccctggtggccaccttcgtgcccggctgcccctgggagaccaacgataccctgttctcagtggtagcactgccgtggctcagtgagggggagcacgtggtggacgtggtggtggaaaacagcgccagccgggccaacctcagcctgcgggtgacggcggaggagcccatctgtggcctccgcgccacgcccagccccgaggcccgtgtactgcagggagtcctagtgaggtacagccccgtggtggaggccggctcggacatggtcttccggtggaccatcaacgacaagcagtccctgaccttccagaacgtggtcttcaatgtcatttatcagagcgcggcggtcttcaagctctcactgacggcctccaaccacgtgagcaacgtcaccgtgaactacaacgtaaccgtggagcggatgaacaggatgcagggtctgcaggtctccacagtgccggccgtgctgtcccccaatgccacgctagcactgacggcgggcgtgctggtggactcggccgtggaggtggccttcctgtggacctttggggatggggagcaggccctccaccagttccagcctccgtacaacgagtccttcccggttccagacccctcggtggcccaggtgctggtggagcacaatgtcatgcacacctacgctgccccaggtgagtacctcctgaccgtgctggcatctaatgccttcgagaacctgacgcagcaggtgcctgtgagcgtgcgcgcctccctgccctccgtggctgtgggtgtgagtgacggcgtcctggtggccggccggcccgtcaccttctacccgcacccgctgccctcgcctgggggtgttctttacacgtgggacttcggggacggctcccctgtcctgacccagagccagccggctgccaaccacacctatgcctcgaggggcacctaccacgtgcgcctggaggtcaacaacacggtgagcggtgcggcggcccaggcggatgtgcgcgtctttgaggagctccgcggactcagcgtggacatgagcctggccgtggagcagggcgcccccgtggtggtcagcgccgcggtgcagacgggcgacaacatcacgtggaccttcgacatgggggacggcaccgtgctgtcgggcccggaggcaacagtggagcatgtgtacctgcgggcacagaactgcacagtgaccgtgggtgcggccagccccgccggccacctggcccggagcctgcacgtgctggtcttcgtcctggaggtgctgcgcgttgaacccgccgcctgcatccccacgcagcctgacgcgcggctcacggcctacgtcaccgggaacccggcccactacctcttcgactggaccttcggggatggctcctccaacacgaccgtgcgggggtgcccgacggtgacacacaacttcacgcggagcggcacgttccccctggcgctggtgctgtccagccgcgtgaacagggcgcattacttcaccagcatctgcgtggagccagaggtgggcaacgtcaccctgcagccagagaggcagtttgtgcagctcggggacgaggcctggctggtggcatgtgcctggcccccgttcccctaccgctacacctgggactttggcaccgaggaagccgcccccacccgtgccaggggccctgaggtgacgttcatctaccgagacccaggctcctatcttgtgacagtcaccgcgtccaacaacatctctgctgccaatgactcagccctggtggaggtgcaggagcccgtgctggtcaccagcatcaaggtcaatggctcccttgggctggagctgcagcagccgtacctgttctctgctgtgggccgtgggcgccccgccagctacctgtgggatctgggggacggtgggtggctcgagggtccggaggtcacccacgcttacaacagcacaggtgacttcaccgttagggtggccggctggaatgaggtgagccgcagcgaggcctggctcaatgtgacggtgaagcggcgcgtgcgggggctcgtcgtcaatgcaagccgcacggtggtgcccctgaatgggagcgtgagcttcagcacgtcgctggaggccggcagtgatgtgcgctattcctgggtgctctgtgaccgctgcacgcccatccctgggggtcctaccatctcttacaccttccgctccgtgggcaccttcaatatcatcgtcacggctgagaacgaggtgggctccgcccaggacagcatcttcgtctatgtcctgcagctcatagaggggctgcaggtggtgggcggtggccgctacttccccaccaaccacacggtacagctgcaggccgtggttagggatggcaccaacgtctcctacagctggactgcctggagggacaggggcccggccctggccggcagcggcaaaggcttctcgctcaccgtgctcgaggccggcacctaccatgtgcagctgcgggccaccaacatgctgggcagcgcctgggccgactgcaccatggacttcgtggagcctgtggggtggctgatggtggccgcctccccgaacccagctgccgtcaacacaagcgtcaccctcagtgccgagctggctggtggcagtggtgtcgtatacacttggtccttggaggaggggctgagctgggagacctccgagccatttaccacccatagcttccccacacccggcctgcacttggtcaccatgacggcagggaacccgctgggctcagccaacgccaccgtggaagtggatgtgcaggtgcctgtgagtggcctcagcatcagggccagcgagcccggaggcagcttcgtggcggccgggtcctctgtgcccttttgggggcagctggccacgggcaccaatgtgagctggtgctgggctgtgcccggcggcagcagcaagcgtggccctcatgtcaccatggtcttcccggatgctggcaccttctccatccggctcaatgcctccaacgcagtcagctgggtctcagccacgtacaacctcacggcggaggagcccatcgtgggcctggtgctgtgggccagcagcaaggtggtggcgcccgggcagctggtccattttcagatcctgctggctgccggctcagctgtcaccttccgcctgcaggtcggcggggccaaccccgaggtgctccccgggccccgtttctcccacagcttcccccgcgtcggagaccacgtggtgagcgtgcggggcaaaaaccacgtgagctgggcccaggcgcaggtgcgcatcgtggtgctggaggccgtgagtgggctgcaggtgcccaactgctgcgagcctggcatcgccacgggcactgagaggaacttcacagcccgcgtgcagcgcggctctcgggtcgcctacgcctggtacttctcgctgcagaaggtccagggcgactcgctggtcatcctgtcgggccgcgacgtcacctacacgcccgtggccgcggggctgttggagatccaggtgcgcgccttcaacgccctgggcagtgagaaccgcacgctggtgctggaggttcaggacgccgtccagtatgtggccctgcagagcggcccctgcttcaccaaccgctcggcgcagtttgaggccgccaccagccccagcccccggcgtgtggcctaccactgggactttggggatgggtcgccagggcaggacacagatgagcccagggccgagcactcctacctgaggcctggggactaccgcgtgcaggtgaacgcctccaacctggtgagcttcttcgtggcgcaggccacggtgaccgtccaggtgctggcctgccgggagccggaggtggacgtggtcctgcccctgcaggtgctgatgcggcgatcacagcgcaactacttggaggcccacgttgacctgcgcgactgcgtcacctaccagactgagtaccgctgggaggtgtatcgcaccgccagctgccagcggccggggcgcccagcgcgtgtggccctgcccggcgtggacgtgagccggcctcggctggtgctgccgcggctggcgctgcctgtggggcactactgctttgtgtttgtcgtgtcatttggggacacgccactgacacagagcatccaggccaatgtgacggtggcccccgagcgcctggtgcccatcattgagggtggctcataccgcgtgtggtcagacacacgggacctggtgctggatgggagcgagtcctacgaccccaacctggaggacggcgaccagacgccgctcagtttccactgggcctgtgtggcttcgacacagagggaggctggcgggtgtgcgctgaactttgggccccgcgggagcagcacggtcaccattccacgggagcggctggcggctggcgtggagtacaccttcagcctgaccgtgtggaaggccggccgcaaggaggaggccaccaaccagacggtgctgatccggagtggccgggtgcccattgtgtccttggagtgtgtgtcctgcaaggcacaggccgtgtacgaagtgagccgcagctcctacgtgtacttggagggccgctgcctcaattgcagcagcggctccaagcgagggcggtgggctgcacgtacgttcagcaacaagacgctggtgctggatgagaccaccacatccacgggcagtgcaggcatgcgactggtgctgcggcggggcgtgctgcgggacggcgagggatacaccttcacgctcacggtgctgggccgctctggcgaggaggagggctgcgcctccatccgcctgtcccccaaccgcccgccgctggggggctcttgccgcctcttcccactgggcgctgtgcacgccctcaccaccaaggtgcacttcgaatgcacgggctggcatgacgcggaggatgctggcgccccgctggtgtacgccctgctgctgcggcgctgtcgccagggccactgcgaggagttctgtgtctacaagggcagcctctccagctacggagccgtgctgcccccgggtttcaggccacacttcgaggtgggcctggccgtggtggtgcaggaccagctgggagccgctgtggtcgccctcaacaggtctttggccatcaccctcccagagcccaacggcagcgcaacggggctcacagtctggctgcacgggctcaccgctagtgtgctcccagggctgctgcggcaggccgatccccagcacgtcatcgagtactcgttggccctggtcaccgtgctgaacgagtacgagcgggccctggacgtggcggcagagcccaagcacgagcggcagcaccgagcccagatacgcaagaacatcacggagactctggtgtccctgagggtccacactgtggatgacatccagcagatcgctgctgcgctggcccagtgcatggggcccagcagggagctcgtatgccgctcgtgcctgaagcagacgctgcacaagctggaggccatgatgctcatcctgcaggcagagaccaccgcgggcaccgtgacgcccaccgccatcggagacagcatcctcaacatcacaggagacctcatccacctggccagctcggacgtgcgggcaccacagccctcagagctgggagccgagtcaccatctcggatggtggcgtcccaggcctacaacctgacctctgccctcatgcgcatcctcatgcgctcccgcgtgctcaacgaggagcccctgacgctggcgggcgaggagatcgtggcccagggcaagcgctcggacccgcggagcctgctgtgctatggcggcgccccagggcctggctgccacttctccatccccgaggctttcagcggggccctggccaacctcagtgacgtggtgcagctcatctttctggtggactccaatccctttccctttggctatatcagcaactacaccgtctccaccaaggtggcctcgatggcattccagacacaggccggcgcccagatccccatcgagcggctggcctcagagcgcgccatcaccgtgaaggtgcccaacaactcggactgggctgcccggggccaccgcagctccgccaactccgccaactccgttgtggtccagccccaggcctccgtcggtgctgtggtcaccctggacagcagcaaccctgcggccgggctgcatctgcagctcaactatacgctgctggacggccactacctgtctgaggaacctgagccctacctggcagtctacctacactcggagccccggcccaatgagcacaactgctcggctagcaggaggatccgcccagagtcactccagggtgctgaccaccggccctacaccttcttcatttccccggggagcagagacccagcggggagttaccatctgaacctctccagccacttccgctggtcggcgctgcaggtgtccgtgggcctgtacacgtccctgtgccagtacttcagcgaggaggacatggtgtggcggacagaggggctgctgcccctggaggagacctcgccccgccaggccgtctgcctcacccgccacctcaccgccttcggcgccagcctcttcgtgcccccaagccatgtccgctttgtgtttcctgagccgacagcggatgtaaactacatcgtcatgctgacatgtgctgtgtgcctggtgacctacatggtcatggccgccatcctgcacaagctggaccagttggatgccagccggggccgcgccatccctttctgtgggcagcggggccgcttcaagtacgagatcctcgtcaagacaggctggggccggggctcaggtaccacggcccacgtgggcatcatgctgtatggggtggacagccggagcggccaccggcacctggacggcgacagagccttccaccgcaacagcctggacatcttccggatcgccaccccgcacagcctgggtagcgtgtggaagatccgagtgtggcacgacaacaaagggctcagccctgcctggttcctgcagcacgtcatcgtcagggacctgcagacggcacgcagcgccttcttcctggtcaatgactggctttcggtggagacggaggccaacgggggcctggtggagaaggaggtgctggccgcgagcgacgcagcccttttgcgcttccggcgcctgctggtggctgagctgcagcgtggcttctttgacaagcacatctggctctccatatgggaccggccgcctcgtagccgtttcactcgcatccagagggccacctgctgcgttctcctcatctgcctcttcctgggcgccaacgccgtgtggtacggggctgttggcgactctgcctacagcacggggcatgtgtccaggctgagcccgctgagcgtcgacacagtcgctgttggcctggtgtccagcgtggttgtctatcccgtctacctggccatcctttttctcttccggatgtcccggagcaaggtggctgggagcccgagccccacacctgccgggcagcaggtgctggacatcgacagctgcctggactcgtccgtgctggacagctccttcctcacgttctcaggcctccacgctgaggcctttgttggacagatgaagagtgacttgtttctggatgattctaagagtctggtgtgctggccctccggcgagggaacgctcagttggccggacctgctcagtgacccgtccattgtgggtagcaatctgcggcagctggcacggggccaggcgggccatgggctgggcccagaggaggacggcttctccctggccagcccctactcgcctgccaaatccttctcagcatcagatgaagacctgatccagcaggtccttgccgagggggtcagcagcccagcccctacccaagacacccacatggaaacggacctgctcagcagcctgtccagcactcctggggagaagacagagacgctggcgctgcagaggctgggggagctggggccacccagcccaggcctgaactgggaacagccccaggcagcgaggctgtccaggacaggactggtggagggtctgcggaagcgcctgctgccggcctggtgtgcctccctggcccacgggctcagcctgctcctggtggctgtggctgtggctgtctcagggtgggtgggtgcgagcttccccccgggcgtgagtgttgcgtggctcctgtccagcagcgccagcttcctggcctcattcctcggctgggagccactgaaggtcttgctggaagccctgtacttctcactggtggccaagcggctgcacccggatgaagatgacaccctggtagagagcccggctgtgacgcctgtgagcgcacgtgtgccccgcgtacggccaccccacggctttgcactcttcctggccaaggaagaagcccgcaaggtcaagaggctacatggcatgctgcggagcctcctggtgtacatgctttttctgctggtgaccctgctggccagctatggggatgcctcatgccatgggcacgcctaccgtctgcaaagcgccatcaagcaggagctgcacagccgggccttcctggccatcacgcggtctgaggagctctggccatggatggcccacgtgctgctgccctacgtccacgggaaccagtccagcccagagctggggcccccacggctgcggcaggtgcggctgcaggaagcactctacccagaccctcccggccccagggtccacacgtgctcggccgcaggaggcttcagcaccagcgattacgacgttggctgggagagtcctcacaatggctcggggacgtgggcctattcagcgccggatctgctgggggcatggtcctggggctcctgtgccgtgtatgacagcgggggctacgtgcaggagctgggcctgagcctggaggagagccgcgaccggctgcgcttcctgcagctgcacaactggctggacaacaggagccgcgctgtgttcctggagctcacgcgctacagcccggccgtggggctgcacgccgccgtcacgctgcgcctcgagttcccggcggccggccgcgccctggccgccctcagcgtccgcccctttgcgctgcgccgcctcagcgcgggcctctcgctgcctctgctcacctcggtgtgcctgctgctgttcgccgtgcacttcgccgtggccgaggcccgtacttggcacagggaagggcgctggcgcgtgctgcggctcggagcctgggcgcggtggctgctggtggcgctgacggcggccacggcactggtacgcctcgcccagctgggtgccgctgaccgccagtggacccgtttcgtgcgcggccgcccgcgccgcttcactagcttcgaccaggtggcgcagctgagctccgcagcccgtggcctggcggcctcgctgctcttcctgcttttggtcaaggctgcccagcagctacgcttcgtgcgccagtggtccgtctttggcaagacattatgccgagctctgccagagctcctgggggtcaccttgggcctggtggtgctcggggtagcctacgcccagctggccatcctgctcgtgtcttcctgtgtggactccctctggagcgtggcccaggccctgttggtgctgtgccctgggactgggctctctaccctgtgtcctgccgagtcctggcacctgtcacccctgctgtgtgtggggctctgggcactgcggctgtggggcgccctacggctgggggctgttattctccgctggcgctaccacgccttgcgtggagagctgtaccggccggcctgggagccccaggactacgagatggtggagttgttcctgcgcaggctgcgcctctggatgggcctcagcaaggtcaaggagttccgccacaaagtccgctttgaagggatggagccgctgccctctcgctcctccaggggctccaaggtatccccggatgtgcccccacccagcgctggctccgatgcctcgcacccctccacctcctccagccagctggatgggctgagcgtgagcctgggccggctggggacaaggtgtgagcctgagccctcccgcctccaagccgtgttcgaggccctgctcacccagtttgaccgactcaaccaggccacagaggacgtctaccagctggagcagcagctgcacagcctgcaaggccgcaggagcagccgggcgcccgccggatcttcccgtggcccatccccgggcctgcggccagcactgcccagccgccttgcccgggccagtcggggtgtggacctggccactggccccagcaggacaccccttcgggccaagaacaaggtccaccccagcagcacttagtcctccttcctggcgggggtgggccgtggagtcggagtggacaccgctcagtattactttctgccgctgtcaaggccgagggccaggcagaatggctgcacgtaggttccccagagagcaggcaggggcatctgtctgtctgtgggcttcagcactttaaagaggctgtgtggccaaccaggacccagggtcccctccccagctcccttgggaaggacacagcagtattggacggtttctagcctctgagatgctaatttatttccccgagtcctcaggtacagcgggctgtgcccggccccaccccctgggcagatgtcccccactgctaaggctgctggcttcagggagggttagcctgcaccgccgccaccctgcccctaagttattacctctccagttcctaccgtactccctgcaccgtctcactgtgtgtctcgtgtcagtaatttatatggtgttaaaatgtgtatatttttgtatgtcactattttcactagggctgaggggcctgcgcccagagctggcctcccccaacacctgctgcgcttggtaggtgtggtggcgttatggcagcccggctgctgcttggatgcgagcttggccttgggccggtgctgggggcacagctgtctgccaggcactctcatcaccccagaggccttgtcatcctcccttgccccaggccaggtagcaagagagcagcgcccaggcctgctggcatcaggtctgggcaagtagcaggactaggcatgtcagaggaccccagggtggttagaggaaaagactcctcctgggggctggctcccagggtggaggaaggtgactgtgtgtgtgtgtgtgtgcgcgcgcgcacgcgcgagtgtgctgtatggcccaggcagcctcaaggccctcggagctggctgtgcctgcttctgtgtaccacttctgtgggcatggccgcttctagagcctcgacacccccccaacccccgcaccaagcagacaaagtcaataaaagagctgtctgactgc

SEQ ID NO: 14 - DNA, 2699 bp, Homo sapiens
ggagcgcttaagaggagggtcgggctcggccggggagtcccagtggcggaggctacgaaacttgggggagtgcacagaagaacttcgggagcgcacgcgggaccagggaccaggctgagactcggggcgccagtccgggcaggggcagcgggagccggccgggtagggtgcagcctgaggcttgttcagcagaacaggtgcaagccacattgttgccaagacctgcctgaagccggattctccccactgcctccttcaaccccgcctcttcctcctcctgtgggactgctcccccctcctgtgaggctagatagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggcttcttcaagcgcacagtgcagaaaaacgccaagtacatctgcctggctaacaaggactgccctgtggacaagaggcggcgaaaccgctgccagttctgccgcttccagaagtgcctggcggtgggcatggtgaaggaagttgtccgaacagacagcctgaaggggcggcggggccggctaccttcaaaacccaagcagcccccagatgcctcccctgccaatctcctcacttccctggtccgtgcacacctggactcagggcccagcactgccaaactggactactccaagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccgaccggcatgggctgcaggagccgcggcgggtggaggagctgcagaaccgcatcgccagctgcctgaaggagcacgtggcagctgtggcgggcgagccccagccagccagctgcctgtcacgtctgttgggcaaactgcccgagctgcggaccctgtgcacccagggcctgcagcgcatcttctacctcaagctggaggacttggtgccccctccacccatcattgacaagatcttcatggacacgctgcccttctgacccctgcctgggaacacgtgtgcacatgcgcactctcatatgccaccccatgtgcctttagtccacggacccccagagcacccccaagcctgggcttgagctgcagaatgactccaccttctcacctgctccaggaggtttgcagggagctcaagcccttggggagggggatgccttcatgggggtgaccccacgatttgtcttatcccccccagcctggccccggcctttatgttttttgtaagataaaccgtttttaacacatagcgccgtgctgtaaataagcccagtgctgctgtaaatacaggaagaaagagcttgaggtgggagcggggctgggaggaagggatgggccccgccttcctgggcagcctttccagcctcctgctggctctctcttcctaccctccttccacatgtacataaactgtcactctaggaagaagacaaatgacagattctgacatttatatttgtgtattttcctggatttatagtatgtgacttttctgattaatatatttaatatattgaataaaaaatagacatgtagttggaaaaaaaaaaaaaaaaaaaaaaaaaaaaaaa

SEQ ID NO: 15 - DNA, 5511 bp, Homo sapiens
acacacacacacccctcccctgccatccctccccggactccggctccggctccgattgcaatttgcaacctccgctgccgtcgccgcagcagccaccaattcgccagcggttcaggtggctcttgcctcgatgtcctagcctaggggcccccgggccggacttggctgggctcccttcaccctctgcggagtcatgagggcgaacgacgctctgcaggtgctgggcttgcttttcagcctggcccggggctccgaggtgggcaactctcaggcagtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaactccagccacgctctgcgccagctccgcttgactcagctcaccgagattctgtcagggggtgtttatattgagaagaacgataagctttgtcacatggacacaattgactggagggacatcgtgagggaccgagatgctgagatagtggtgaaggacaatggcagaagctgtcccccctgtcatgaggtttgcaaggggcgatgctggggtcctggatcagaagactgccagacattgaccaagaccatctgtgctcctcagtgtaatggtcactgctttgggcccaaccccaaccagtgctgccatgatgagtgtgccgggggctgctcaggccctcaggacacagactgctttgcctgccggcacttcaatgacagtggagcctgtgtacctcgctgtccacagcctcttgtctacaacaagctaactttccagctggaacccaatccccacaccaagtatcagtatggaggagtttgtgtagccagctgtccccataactttgtggtggatcaaacatcctgtgtcagggcctgtcctcctgacaagatggaagtagataaaaatgggctcaagatgtgtgagccttgtgggggactatgtcccaaagcctgtgagggaacaggctctgggagccgcttccagactgtggactcgagcaacattgatggatttgtgaactgcaccaagatcctgggcaacctggactttctgatcaccggcctcaatggagacccctggcacaagatccctgccctggacccagagaagctcaatgtcttccggacagtacgggagatcacaggttacctgaacatccagtcctggccgccccacatgcacaacttcagtgttttttccaatttgacaaccattggaggcagaagcctctacaaccggggcttctcattgttgatcatgaagaacttgaatgtcacatctctgggcttccgatccctgaaggaaattagtgctgggcgtatctatataagtgccaataggcagctctgctaccaccactctttgaactggaccaaggtgcttcgggggcctacggaagagcgactagacatcaagcataatcggccgcgcagagactgcgtggcagagggcaaagtgtgtgacccactgtgctcctctgggggatgctggggcccaggccctggtcagtgcttgtcctgtcgaaattatagccgaggaggtgtctgtgtgacccactgcaactttctgaatggggagcctcgagaatttgcccatgaggccgaatgcttctcctgccacccggaatgccaacccatggagggcactgccacatgcaatggctcgggctctgatacttgtgctcaatgtgcccattttcgagatgggccccactgtgtgagcagctgcccccatggagtcctaggtgccaagggcccaatctacaagtacccagatgttcagaatgaatgtcggccctgccatgagaactgcacccaggggtgtaaaggaccagagcttcaagactgtttaggacaaacactggtgctgatcggcaaaacccatctgacaatggctttgacagtgatagcaggattggtagtgattttcatgatgctgggcggcacttttctctactggcgtgggcgccggattcagaataaaagggctatgaggcgatacttggaacggggtgagagcatagagcctctggaccccagtgagaaggctaacaaagtcttggccagaatcttcaaagagacagagctaaggaagcttaaagtgcttggctcgggtgtctttggaactgtgcacaaaggagtgtggatccctgagggtgaatcaatcaagattccagtctgcattaaagtcattgaggacaagagtggacggcagagttttcaagctgtgacagatcatatgctggccattggcagcctggaccatgcccacattgtaaggctgctgggactatgcccagggtcatctctgcagcttgtcactcaatatttgcctctgggttctctgctggatcatgtgagacaacaccggggggcactggggccacagctgctgctcaactggggagtacaaattgccaagggaatgtactaccttgaggaacatggtatggtgcatagaaacctggctgcccgaaacgtgctactcaagtcacccagtcaggttcaggtggcagattttggtgtggctgacctgctgcctcctgatgataagcagctgctatacagtgaggccaagactccaattaagtggatggcccttgagagtatccactttgggaaatacacacaccagagtgatgtctggagctatggtgtgacagtttgggagttgatgaccttcggggcagagccctatgcagggctacgattggctgaagtaccagacctgctagagaagggggagcggttggcacagccccagatctgcacaattgatgtctacatggtgatggtcaagtgttggatgattgatgagaacattcgcccaacctttaaagaactagccaatgagttcaccaggatggcccgagacccaccacggtatctggtcataaagagagagagtgggcctggaatagcccctgggccagagccccatggtctgacaaacaagaagctagaggaagtagagctggagccagaactagacctagacctagacttggaagcagaggaggacaacctggcaaccaccacactgggctccgccctcagcctaccagttggaacacttaatcggccacgtgggagccagagccttttaagtccatcatctggatacatgcccatgaaccagggtaatcttggggagtcttgccaggagtctgcagtttctgggagcagtgaacggtgcccccgtccagtctctctacacccaatgccacggggatgcctggcatcagagtcatcagaggggcatgtaacaggctctgaggctgagctccaggagaaagtgtcaatgtgtaggagccggagcaggagccggagcccacggccacgcggagatagcgcctaccattcccagcgccacagtctgctgactcctgttaccccactctccccacccgggttagaggaagaggatgtcaacggttatgtcatgccagatacacacctcaaaggtactccctcctcccgggaaggcaccctttcttcagtgggtctcagttctgtcctgggtactgaagaagaagatgaagatgaggagtatgaatacatgaaccggaggagaaggcacagtccacctcatccccctaggccaagttcccttgaggagctgggttatgagtacatggatgtggggtcagacctcagtgcctctctgggcagcacacagagttgcccactccaccctgtacccatcatgcccactgcaggcacaactccagatgaagactatgaatatatgaatcggcaacgagatggaggtggtcctgggggtgattatgcagccatgggggcctgcccagcatctgagcaagggtatgaagagatgagagcttttcaggggcctggacatcaggccccccatgtccattatgcccgcctaaaaactctacgtagcttagaggctacagactctgcctttgataaccctgattactggcatagcaggcttttccccaaggctaatgcccagagaacgtaactcctgctccctgtggcactcagggagcatttaatggcagctagtgcctttagagggtaccgtcttctccctattccctctctctcccaggtcccagccccttttccccagtcccagacaattccattcaatctttggaggcttttaaacattttgacacaaaattcttatggtatgtagccagctgtgcactttcttctctttcccaaccccaggaaaggttttccttattttgtgtgctttcccagtcccattcctcagcttcttcacaggcactcctggagatatgaaggattactctccatatcccttcctctcaggctcttgactacttggaactaggctcttatgtgtgcctttgtttcccatcagactgtcaagaagaggaaagggaggaaacctagcagaggaaagtgtaattttggtttatgactcttaaccccctagaaagacagaagcttaaaatctgtgaagaaagaggttaggagtagatattgattactatcataattcagcacttaactatgagccaggcatcatactaaacttcacctacattatctcacttagtcctttatcatccttaaaacaattctgtgacatacatattatctcattttacacaaagggaagtcgggcatggtggctcatgcctgtaatctcagcactttgggaggctgaggcagaaggattacctgaggcaaggagtttgagaccagcttagccaacatagtaagacccccatctctttaaaaaaaaaaaaaaaaaaaaaaaaaaaactttagaactgggtgcagtggctcatgcctgtaatcccagccagcactttgggaggctgagatgggaagatcacttgagcccagaattagagataagcctatggaaacatagcaagacactgtctctacaggggaaaaaaaaaaaagaaactgagccttaaagagatgaaataaattaagcagtagatccaggatgcaaaatcctcccaattcctgtgcatgtgctcttattgtaaggtgccaagaaaaactgatttaagttacagcccttgtttaaggggcactgtttcttgtttttgcactgaatcaagtctaaccccaacagccacatcctcctatacctagacatctcatctcaggaagtggtggtgggggtagtcagaaggaaaaataactggacatctttgtgtaaaccataatccacatgtgccgtaaatgatcttcactccttatccgagggcaaattcacaaggatccccaagatccacttttagaagccattctcatcca

SEQ ID NO: 16 - DNA, 546 bp, Homo sapiens
gatttctcccggaacctctgctcagcctggtgaaccacacaggccagcgctctgacatgcagaaggtgaccctgggcctgcttgtgttcctggcaggctttcctgtcctggacgccaatgacctagaagataaaaacagtcctttctactatgactggcacagcctccaggttggcgggctcatctgcgctggggttctgtgcgccatgggcatcatcatcgtcatgagtgcaaaatgcaaatgcaagtttggccagaagtccggtcaccatccaggggagactccacctctcatcaccccaggctcagcccaaagctgatgaggacagaccagctgaaattgggtggaggaccgttctctgtccccaggtcctgtctctgcacagaaacttgaactccaggatggaattcttcctcctctgctgggactcctttgcatggcagggcctcatctcacctctcgcaagagggtctctttgttcaattttttttaatctaaaatgattgtgcctctccaaaaaaaaaaaaaaaaaaaaaaaaaaaaaa

SEQ ID NO: 17 - DNA, 1938 bp, Homo sapiens
gactttggtggcaagaggagctggcggagcccagccagtgggcggggccaggggaggggcgggcaggtaggtgcagccactcctgggaggaccctgcgtggccagacggtgctggtgactcgtccacactgctcgcttcggatactccaggcgtctcccgttgcggccgctccctgccttagaggccagccttggacacttgctgcccctttccagcccggattctgggatccttccctctgagccaacatctgggtcctgccttcgacaccaccccaaggcttcctaccttgcgtgcctggagtctgccccaggggcccttgtcctgggccatggcccagaagggggtcctggggcctgggcagctgggggctgtggccattctgctctatcttggattactccggtcggggacaggagcggaaggggcagaagctccctgcggtgtggccccccaagcacgcatcacaggtggcagcagtgcagtcgccggtcagtggccctggcaggtcagcatcacctatgaaggcgtccatgtgtgtggtggctctctcgtgtctgagcagtgggtgctgtcagctgctcactgcttccccagcgagcaccacaaggaagcctatgaggtcaagctgggggcccaccagctagactcctactccgaggacgccaaggtcagcaccctgaaggacatcatcccccaccccagctacctccaggagggctcccagggcgacattgcactcctccaactcagcagacccatcaccttctcccgctacatccggcccatctgcctccctgcagccaacgcctccttccccaacggcctccactgcactgtcactggctggggtcatgtggccccctcagtgagcctcctgacgcccaagccactgcagcaactcgaggtgcctctgatcagtcgtgagacgtgtaactgcctgtacaacatcgacgccaagcctgaggagccgcactttgtccaagaggacatggtgtgtgctggctatgtggaggggggcaaggacgcctgccagggtgactctgggggcccactctcctgccctgtggagggtctctggtacctgacgggcattgtgagctggggagatgcctgtggggcccgcaacaggcctggtgtgtacactctggcctccagctatgcctcctggatccaaagcaaggtgacagaactccagcctcgtgtggtgccccaaacccaggagtcccagcccgacagcaacctctgtggcagccacctggccttcagctctgccccagcccagggcttgctgaggcccatccttttcctgcctctgggcctggctctgggcctcctctccccatggctcagcgagcactgagctggccctacttccaggatggatgcatcacactcaaggacaggagcctggtccttccctgatggcctttggacccagggcctgacttgagccactccttccttcaggactctgcgggaggctggggccccatcttgatctttgagcccattcttctgggtgtgctttttgggaccatcactgagagtcaggagttttactgcctgtagcaatggccagagcctctggcccctcacccaccatggaccagcccattggccgagctcctggggagctcctgggacccttggctatgaaaatgagccctggctcccacctgtttctggaagactgctcccggcccgcctgcccagactgatgagcacatctctctgccctctccctgtgttctgggctggggccacctttgtgcagcttcgaggacaggaaaggccccaatcttgcccactggccgctgagcgcccccgagccctgactcctggactccggaggactgagcccccaccggaactgggctggcgcttggatctggggtgggagtaacagggcagaaatgattaaaatgtttgagcac

SEQ ID NO: 18 - DNA, 561 bp, Homo sapiens
  misc_feature (1)..(561): n = a,c,t, or g
agttcattcatttattccagcaacaaatatttgagaacacactgtgtcccagacactgttctaaggactggcagcgaagtccaagacaaacagtccctaccttcagcaagtttgcagtcaagcaggatgcggatgctgagcattacaagggaaatgattattctgagagaggaagtatggggtgctatgggaacatacaaccagggacctaattttatgggaaagggaccagcccagatccaacacttgctctcccagtttacctccagtaggttctttttaacttgaactaatcttgtttggtggggtacacagtgaggaaaaagaagagctagtgacaaaatctaactcccttctcagtcttaagcaaggtgaaggcaagggagtagaagatatcaagggagtgagtggtggtagccaccaaagggagatagcagactgaggncctaaaaaaagaaaggaaatctaaatctatcagcaggncngagaaagaatgcttaaggtgattanatgggatcctggatgncctttcccggattttaaaagaanccnaaccnggga

SEQ ID NO: 19 - DNA, 3891 bp, Homo sapiens
gcgcactctggggaaagcggagctgcaccccgccccgtattgctgctcagctcctcagctgtgcgtgcgagggacgtcgggggtggcgccgcagcagttgcccctggtaacgggggaggcagcaggaggaggaggaggaggagggactcggcgggaggatgggcttgctctcaattttgcgcaagttgaaaagtgcaccagaccaggaggtgagaatacttctcctgggcttggataatgctggcaagaccactcttctgaagcagcttgcatctgaagacatcagccacatcacacctacacagggtttcaacatcaaaagtgtacaatcacaaggttttaaactgaatgtatgggacattggtggacagaggaaaatcagaccatactggaagaattattttgaaaataccgatattcttatatatgtaatcgacagtgcagacagaaaaagatttgaagagacgggtcaggaactagcggaattactggaggaagaaaaactaagttgtgtgccagtgctcatctttgctaataagcaggatttgctcacagcagcccctgcctctgaaattgcagaaggactgaacctgcataccatccgcgaccgagtctggcagatccagtcttgctcagctctcacaggagagggcgttcaggatggcatgaactgggtctgcaaaaatgtcaatgcaaagaagaaataaaatctagacgaatggagatgcaggagctgcgggagccgaattcggtcctgaaaaacactaatttgctgctttctgaccaaatgtttttccatctgtgtacagctccagctgtttgaagagagggaacaacacggtttagaaagaatccccattccagcagtagatttaactgatctctgaggttcagtatcatttttcaaataaaggaattatattatttcctctgcataattgaaatagtattaaatgtctcaaagcacatgattagaaaatgagatcttttaaatgagcaagagattgcattgcagtttagacaattccagtgggcttttttttcctctcaaaaaaaaaaaaagaaaaagaaaaagaggaagaagcagctttgctgagttcatttatttactgacccgtcccttgcattccctccatggttttgaaaccacagacagtgtttgctggtgctgtcagtgatttttaccgtcactagcccagccaggcttcagtctgtccgacaggaagctgctgggtgggggtggggggagaaaaggcagataattaaaccatctcatcgtcttgcaggtcggagactacgtatgtaatcctcactctttggacagaaaaaaaaaaaaaagtctttcttgcagacaagtcactacagaaacataccccatcccacccacccctgcctctgccccagccagccacacagagaagcaaattcttatgacttttgactgtaatgacatctggaatgtaaggagaggtgggaggtttaattccagaaaaattacaaggtccttaaaaagctctcacatcgagggctcaggctagcgtaaacaggctttctccagctcagtggagcagtgagcagccgactctgagattagctggcttctccacggccgtcctatagacaggatttctaaagctcaaagaattctgtgtttaaacgatcacaataggccgctgctatcagattttagaaataaatgcagctttaccatgaacctgctccactgagaaaagccaggcagatcgatttttagatcaatttttacagtgctggcaacttggtggtgtgggatgctcctggatggagagggtttgctgctggggaggacatgggtgtgtgtgtgactgcaggggtcgtgtccaaggaatcaagagtcaccccagctgctgggctcctctgcctctctgcagcagaatgtccgtcctctgttgattgattggagaggaatagcagaacatttctcctgcccctcgttgcaaaacgagcttgtttccctgaacctcagaaatcctcagcttcaaacatggggaaacaggccagagcattgcccggctcctgaattaaactctgttctggtgcctgagctcaggggttttcagagaatgaataagagactgtccagtgactggtgggtccctgggggccagctgccttctcatcctgggaggtggcccttcccaagcccatcagggcgtgtgagcagactgaaggggccgctgcagcccctggccctcaatacccagctgcttctggctaagagtgcagcagagactgaggcatagccagcttcaaaagcgatctgacatgaaagtcattaacaaagccagccgtgaaaaggtgccccagagttgctgtggacagacctgtaaggacttgcaaaacaaaagaaagtgaggggtttttttaacctcagagctagctgctctctgcagcctcctccactggcttctctggctcacccaagctctcccttacagaggcaacacagaattataaggaatcagaaatcccccttctaccaggctgcaaatgtggctctagcacttgcaaattgttttttcttccgaatagttcagcagggacaagttatctgaggggcaaaatgcctgcttggaggtctgcaattttggaacactgcagtatggaactttggcattggagggtctgtaaaatatttttgttcttttaccaccaacttaggggactgttttaaagagccatcccaaggcctctcctagcaggcagaagccactcctctgataacggcctctgtaaatgttctgatttgctctcagctgcagagacacagagacactgcagatgtcacacgctttcatcttccctttgagcccttttgaaccctcctggggctctggggtagatgagagaagcctgaaaaaggcagagtttgaaagctcccatttaaaaacaaaatactttttaaagccctcttgcctcttccctgcccactcctgccccctgaccagaagacagaatttgaagctggaaagggaagaccccttttcccctcctcctgtccccagtgagtcttagcgagacttttgccctgcgcacaattgcatctgaatgtgcgggggagagggctgggggccggagggcaggcaaggcctggggggtgctcgtgatatgtgctcaagccagttgtgggaaaaactcgagtcctcccctcctcccgacctaccccgtgtggctgcttttggctggattccctgcacccagtgcaacacaccctttccccttcactctcccttggttactatggaaacaagggtgtcattgatgtgggctgagctggggaacatgtcggtgcacagctgaaagtcagcgattatgccggcggttagaaatgtgccagggttaaaggagtccgcagctcccacggctgctgggaggacatggtcctgcccccttccttcctccctccctccgtctccacttctctctccttgcttttgacaaatttctttattcccctctggactaaagtagtggctatttttgtgccactctgcgccccaccctcactgttggccgctccttatccggcctggcctggagggtgacaccatgtcaccctcaccaggactcgtctctccattcccgtcagagtttgctttgatttccctttcctttccttctcggggaccagttcttacttccttttatttttagctctgcactccatgtggtttcagggttcagtctgatccatcaaaaggttctttttttataatcccttttgaaaatgataatcaaaggaagagatgtggtgtttggtcatgtggaaaactcaatgtataatttagacgtctgtcaaaaatccgacaaataaaatttagctggaacgaaaaaaaaaaaaaaaaaaaaaaa

SEQ ID NO: 20 - DNA, 4225 bp, Homo sapiens
ggagtcgcggctgcgagcaggttagagttacttgttattggtaaatagccactatggaggctaaggaccagaagaaacacagaaagaaaaacagtggacccaaagctgcaaagaaaaagaagcggcttctgcaggatctccagctaggagacgaagaagatgcccggaagagaaatcccaaagcttttgcagttcagtctgctgtgcggatggctcgatcctttcacaggactcaggatttgaagacaaaaaagcatcatattccagtggttgatcgaactccactagagcccccaccaatagtggtagtggtgatgggacctccaaaagttggaaagagcactttgatacaatgcctcattcggaactttacccggcagaagttgaccgagatcagaggccctgtgacgattgtgtcaggtaaaaagcgcagactcaccattattgaatgtgggtgtgacattaacatgatgattgatctggctaaagtagcagatctggtactgatgcttatagatgccagctttgggtttgaaatggaaacgtttgagtttctaaacatctgtcaagtacatggctttcctaaaattatgggagttctcacccacctcgactccttcaagcataataagcaactgaagaagacaaagaagcgattaaaacacaggttctggacggaagtttacccgggtgccaagctgttctacctttctggaatggtgcatggagaatatcaaaaccaagaaatccacaatctgggccgttttattacagttatgaagtttaggcctctcacatggcaaacttctcacccttatatcctggcagacaggatggaagatttgacaaacccagaggatatccgaacaaacatcaaatgtgaccggaaggtgtcactttatggttatttaagaggagcacacttgaaaaataaaagccaaattcacatgccaggggtaggagattttgccgtgagtgacatcagtttcctcccagacccttgcgctcttcctgaacaacaaaagaagcgctgtttaaatgagaaggagaagctggtttatgcgcctctttctggagttgggggtgtgctgtatgacaaagacgctgtctatgttgaccttggtggcagccacgtttttcaggatgaagtggggcccacccatgagctggtccagagtctcatctctacccactccaccattgatgccaagatggcttcaagtcgagtgacgctgttttctgattccaagccacttgggtcagaggatatagataatcaagggctaatgatgccaaaggaggaaaaacaaatggacttgaacactggtcgaatgcgtcggaaagccattttcggagatgaagatgaatctggagatagtgatgatgaagaagatgatgaaatgtctgaagatgacgggttggaaaacggctctagtgatgaggaagcagaagaggaggaaaatgctgagatgactgatcagtatatggctgttaagggcatcaaacgacggaaacttgagttggaagaagacagtgaaatggatttgccagcatttgctgacagtgacgatgaccttgagaggagctcagcggaagaaggggaagcggaggaagctgatgaaagcagtgaagaagaggactgcactgcaggagagaagggcatttcaggatcaaaggctgctggagaaggtagtaaagcagggctgtcaccagctaattgccagagtgaccgtgtgaatctggagaagtctttgctgatgaagaaagcagctctccccactttcgattctgggcattgcacagctgaagaggtgtttgcatctgaagatgaatctgaagaaagctcctcactcagtgcagaggaagaagactcagaaaatgaagaggctattagaaaaaagctttcaaagccttctcaagtgagcagtggtcagaaactggggccacagaacttcattgatgagaccagtgatatagaaaatttactcaaagaggaagaagattacaaggaagaaaataatgattccaaagaaacgtcaggtgccctcaagtggaaggaagacctttccagaaaggcagctgaggcctttctgaggcagcagcaagcagctccaaacctccgaaagcttatttatgggacagtgacagaagataatgaagaagaagatgatgatactctagaagagcttggagggttgtttcgtgtcaaccagcctgacagagagtgtaagcacaaggctgactctttggactgctccagatttcttgtggaggccccccatgactgggatttagaggaggttatgaacagtatcagagattgcttcgtgactggaaagtgggaagatgataaagatgcagccaaggtcttagcagaagatgaggagctctacggtgactttgaagacttggaaacaggggacgtgcacaagggaaaatcaggccccaatactcagaatgaagatatagagaaagaagttaaggaagaaattgaccctgacgaagaagaaagtgccaagaaaaagcatttggataagaagagaaaattgaaggagatgtttgatgcagaatatgatgaaggagaaagcacatattttgatgatcttaaaggagaaatgcagaaacaagcacagctgaatcgcgcagaatttgaagatcaagatgatgaagccagagttcagtatgagggttttcgacctgggatgtacgtccgcattgagattgaaaatgttccctgtgaatttgtgcagaactttgacccccattaccccattatcctgggtggcttgggcaacagtgagggaaatgttggctacgtgcagatgcgtctgaagaaacatcgctggtataagaaaatcctcaagtcccgagatccaatcatattttctgtagggtggaggaggtttcagaccatcccactgtattatatcgaagaccacaatggaagacaaaggcttctaaagtataccccacagcacatgcattgcggagcagccttttggggccctatcactccacagggaactggtttcttggcaatacagtctgtcagtggcataatgcctgattttcggatagctgctacaggagttgtccttgatctggataaatccataaaaattgtgaagaaattaaagctaactggttttccatataaaattttcaagaacacttcatttattaagggaatgtttaattctgccttggaagtggccaaatttgaaggtgctgtgattcgaacagtcagtgggataagggggcagatcaagaaagcactccgagctccagaaggagctttcagggccagctttgaggataagctgctgatgagcgatattgtcttcatgcgaacttggtatcctgtttccatcccagcgttctataacccagtaacatctttgttgaaaccagtgggtgagaaagacacctggtcaggaatgcggaccacgggccaactcaggctcgcccatggcatcagactaaaggcgaacaaggactctctgtataagccaatcctgaggcaaaagaaacattttaattcactgcacattccaaaagccttgcagaaggccctgccatttaagaacaagcccaagacccaagcaaaggcaggcaaggtgccaaaggacaggcggagaccggccgtcatacgcgagcctcatgaaagaaagatccttgcactgctggatgctctgagtacggtgcatagtcagaagatgaagaaggccaaggagcagcggcacctgcacaataaagagcacttcagagccaagcagaaggaggaggaggagaagctgaagcggcagaaggacctcaggaagaagctcttcagaattcaggggcagaaggaaagaagaaaccagaagtccagtttgaagggggctgagggccaattgcagtgagcctttggactggagggactgtccctggatctgcggaggtagacagtttcaaacatcacagtttgaatgcctgtgaatgacacgtcagtgggaaagagctcaagagatgtctctactcaaactgtgcctgcaggaggaggaacagagaagcctgggctgctgggactgggttcattctcatgacttggggctgtcgagatttaaagtgatgtaagctgtggttatgtggattctcttactttcctctgcctgcctcagtttaattattttgtcctacagaaatatcattaaaatatttttttgttaaaaaaaaaaaaaaaaaa

SEQ ID NO: 21 - DNA, 1536 bp, Homo sapiens
aacgcaggccgggcgggaagagccaaagcgggcaggcggcggaaatatccgaagcggcggggcgcccgaggccgttgccgacctccgcgctaaagccgctgctgccgcggaagacgatcctccagtacccgcccgccgtcaccgcagctgccgtgtcctcctcccacccctagccgcaccccctcgcggagggatcagctgagcggccaaacggcacggtcgggggagccccgagtccgcagctgcagcggggcctgagaccagagttggcgagggcaaggaaggagcggccccgggcagtgggggcggggccgggcgggcccgagaacagccgaatttggccgagcgctgccgagcgagtccgaggcgctgggccaggccggagccggactacgggagccgaggcgggccgcgcggtgggcgcggagaggagcggagcggcgcggcaggccgggcgggtggcggcagcagcggaggaggccgcagctgcgggtccgaggagcggaggcgacgcgggcggcggcggggggccgggtggccggggtcccgggccccgcggcggcggcagcggcggcggcggcggcaggatgatcaagctgttctcgctgaagcagcagaagaaggaggaggagtcggcgggcggcaccaagggcagcagcaagaaggcgtcggcggcgcagctgcggatccagaaggacataaacgagctgaacctgcccaagacgtgtgatatcagcttctcagatccagacgacctcctcaacttcaagctggtcatctgtcctgatgagggcttctacaagagtgggaagtttgtgttcagttttaaggtgggccagggttacccgcatgatccccccaaggtgaagtgtgagacaatggtctatcaccccaacattgacctcgagggcaacgtctgcctcaacatcctcagagaggactggaagccagtccttacgataaactccataatttatggcctgcagtatctcttcttggagcccaaccccgaggacccactgaacaaggaggccgcagaggtcctgcagaacaaccggcggctgtttgagcagaacgtgcagcgctccatgcggggtggctacatcggctccacctactttgagcgctgcctgaaatagggttggcgcatacccacccccgccacggccacaagccctggcatcccctgcaaatatttattgggggccatgggtaggggtttggggggcggccggtgggggaatcccctgccttggccttgcctccccttcctgccacgtgcccctagttatttttttttttttaacaccatgtgattaaggtcggcgctgcctcccccgacccactcagcgatgggaaatgaattggcttgtctagcccccctgctgggtgcttgttcagcccccactctgggctgtggagtgggtgggcaacgggcctgggtagctgggcccaggcaacccacccctccacctctggaggtcccaccaggctattaaaggggaatgttactgcaaaaaaaaaaaaaaaaaaaaa

SEQ ID NO: 22 - DNA, 1696 bp, Homo sapiens
caaaggacttcctagtgggtgtgaaaggcagcggtggccacagaggcggcggagagatggccttcagcggttcccaggctccctacctgagtccagctgtccccttttctgggactattcaaggaggtctccaggacggacttcagatcactgtcaatgggaccgttctcagctccagtggaaccaggtttgctgtgaactttcagactggcttcagtggaaatgacattgccttccacttcaaccctcggtttgaagatggagggtacgtggtgtgcaacacgaggcagaacggaagctgggggcccgaggagaggaagacacacatgcctttccagaaggggatgccctttgacctctgcttcctggtgcagagctcagatttcaaggtgatggtgaacgggatcctcttcgtgcagtacttccaccgcgtgcccttccaccgtgtggacaccatctccgtcaatggctctgtgcagctgtcctacatcagcttccagaacccccgcacagtccctgttcagcctgccttctccacggtgccgttctcccagcctgtctgtttcccacccaggcccagggggcgcagacaaaaacctcccggcgtgtggcctgccaacccggctcccattacccagacagtcatccacacagtgcagagcgcccctggacagatgttctctactcccgccatcccacctatgatgtacccccaccccgcctatccgatgcctttcatcaccaccattctgggagggctgtacccatccaagtccatcctcctgtcaggcactgtcctgcccagtgctcagaggttccacatcaacctgtgctctgggaaccacatcgccttccacctgaacccccgttttgatgagaatgctgtggtccgcaacacccagatcgacaactcctgggggtctgaggagcgaagtctgccccgaaaaatgcccttcgtccgtggccagagcttctcagtgtggatcttgtgtgaagctcactgcctcaaggtggccgtggatggtcagcacctgtttgaatactaccatcgcctgaggaacctgcccaccatcaacagactggaagtggggggcgacatccagctgacccatgtgcagacataggcggcttcctggccctggggccgggggctggggtgtggggcagtctgggtcctctcatcatccccacttcccaggcccagcctttccaaccctgcctgggatctgggctttaatgcagaggccatgtccttgtctggtcctgcttctggctacagccaccctggaacggagaaggcagctgacggggattgccttcctcagccgcagcagcacctggggctccagctgctggaatcctaccatcccaggaggcaggcacagccagggagaggggaggagtgggcagtgaagatgaagccccatgctcagtcccctcccatcccccacgcagctccaccccagtcccaagccaccagctgtctgctcctggtgggaggtggcctcctcagcccctcctctctgacctttaacctcactctcaccttgcaccgtgcaccaacccttcacccctcctggaaagcaggcctgatggcttcccactggcctccaccacctgaccagagtgttctcttcagaggactggctcctttcccagtgtccttaaaataaagaaatgaaaatgcttgttggca

SEQ ID NO: 23 - DNA, 3649 bp, Homo sapiens
cccgctgtagccgcgtgtgggaggacgcacgggcctgcttcaaagctttgggataacagcgcctccgggggataatgaatgcggagcctccgttttcagtcgacttcagatgtgtctccacttttttccgctgtagccgcaaggcaaggaaacatttctcttcccgtactgaggaggctgaggagtgcactgggtgttcttttctcctctaacccagaactgcgagacagaggctgagtccctgtaaagaacagctccagaaaagccaggagagcgcaggagggcatccgggaggccaggaggggttcgctggggcctcaaccgcacccacatcggtcccacctgcgagggggcgggacctcgtggcgctggaccaatcagcacccacctgcgctcacctggcctcctcccgctggctcccgggggctgcggtgctcaaaggggcaagagctgagcggaacaccggcccgccgtcgcggcagctgcttcacccctctctctgcagccatggggctccctcgtggacctctcgcgtctctcctccttctccaggtttgctggctgcagtgcgcggcctccgagccgtgccgggcggtcttcagggaggctgaagtgaccttggaggcgggaggcgcggagcaggagcccggccaggcgctggggaaagtattcatgggctgccctgggcaagagccagctctgtttagcactgataatgatgacttcactgtgcggaatggcgagacagtccaggaaagaaggtcactgaaggaaaggaatccattgaagatcttcccatccaaacgtatcttacgaagacacaagagagattgggtggttgctccaatatctgtccctgaaaatggcaagggtcccttcccccagagactgaatcagctcaagtctaataaagatagagacaccaagattttctacagcatcacggggccgggggcagacagcccccctgagggtgtcttcgctgtagagaaggagacaggctggttgttgttgaataagccactggaccgggaggagattgccaagtatgagctctttggccacgctgtgtcagagaatggtgcctcagtggaggaccccatgaacatctccatcatcgtgaccgaccagaatgaccacaagcccaagtttacccaggacaccttccgagggagtgtcttagagggagtcctaccaggtacttctgtgatgcaggtgacagccacggatgaggatgatgccatctacacctacaatggggtggttgcttactccatccatagccaagaaccaaaggacccacacgacctcatgttcaccattcaccggagcacaggcaccatcagcgtcatctccagtggcctggaccgggaaaaagtccctgagtacacactgaccatccaggccacagacatggatggggacggctccaccaccacggcagtggcagtagtggagatccttgatgccaatgacaatgctcccatgtttgacccccagaagtacgaggcccatgtgcctgagaatgcagtgggccatgaggtgcagaggctgacggtcactgatctggacgcccccaactcaccagcgtggcgtgccacctaccttatcatgggcggtgacgacggggaccattttaccatcaccacccaccctgagagcaaccagggcatcctgacaaccaggaagggtttggattttgaggccaaaaaccagcacaccctgtacgttgaagtgaccaacgaggccccttttgtgctgaagctcccaacctccacagccaccatagtggtccacgtggaggatgtgaatgaggcacctgtgtttgtcccaccctccaaagtcgttgaggtccaggagggcatccccactggggagcctgtgtgtgtctacactgcagaagaccctgacaaggagaatcaaaagatcagctaccgcatcctgagagacccagcagggtggctagccatggacccagacagtgggcaggtcacagctgtgggcaccctcgaccgtgaggatgagcagtttgtgaggaacaacatctatgaagtcatggtcttggccatggacaatggaagccctcccaccactggcacgggaacccttctgctaacactgattgatgtcaatgaccatggcccagtccctgagccccgtcagatcaccatctgcaaccaaagccctgtgcgccaggtgctgaacatcacggacaaggacctgtctccccacacctcccctttccaggcccagctcacagatgactcagacatctactggacggcagaggtcaacgaggaaggtgacacagtggtcttgtccctgaagaagttcctgaagcaggatacatatgacgtgcacctttctctgtctgaccatggcaacaaagagcagctgacggtgatcagggccactgtgtgcgactgccatggccatgtcgaaacctgccctggaccctggaagggaggtttcatcctccctgtgctgggggctgtcctggctctgctgttcctcctgctggtgctgcttttgttggtgagaaagaagcggaagatcaaggagcccctcctactcccagaagatgacacccgtgacaacgtcttctactatggcgaagaggggggtggcgaagaggaccaggactatgacatcacccagctccaccgaggtctggaggccaggccggaggtggttctccgcaatgacgtggcaccaaccatcatcccgacacccatgtaccgtcctcggccagccaacccagatgaaatcggcaactttataattgagaacctgaaggcggctaacacagaccccacagccccgccctacgacaccctcttggtgttcgactatgagggcagcggctccgacgccgcgtccctgagctccctcacctcctccgcctccgaccaagaccaagattacgattatctgaacgagtggggcagccgcttcaagaagctggcagacatgtacggtggcggggaggacgactaggcggcctgcctgcagggctggggaccaaacgtcaggccacagagcatctccaaggggtctcagttcccccttcagctgaggacttcggagcttgtcaggaagtggccgtagcaacttggcggagacaggctatgagtctgacgttagagtggtggcttccttagcctttcaggatggaggaatgtgggcagtttgacttcagcactgaaaacctctccacctgggccagggttgcctcagaggccaagtttccagaagcctcttacctgccgtaaaatgctcaaccctgtgtcctgggcctgggcctgctgtgactgacctacagtggactttctctctggaatggaaccttcttaggcctcctggtgcaacttaatttttttttttaatgctatcttcaaaacgttagagaaagttcttcaaaagtgcagcccagagctgctgggcccactggccgtcctgcatttctggtttccagaccccaatgcctcccattcggatggatctctgcgtttttatactgagtgtgcctaggttgccccttattttttattttccctgttgcgttgctatagatgaagggtgaggacaatcgtgtatatgtactagaacttttttattaaagaaacttttcccagaaaaaaaaaaaaaa

SEQ ID NO: 24 - DNA, 2869 bp, Homo sapiens
ggtccacccagtgcttgcggcctcgcggccgggccggcctgggctgcaatcaatgcggctttgtctgggacgcccacatcccagaggccattcccgggtcggcaaatcggagcgcggccggggcgcgcgggggtgagataagcggccatgtgatcccacctgggctggaaggggaggggcgccaggtgaggcggcggccggcggggcgcgggcggccacgcggggctcctgcagcatggctgtcagcaggaaggactggtccgcgctgtccagccttgcccggcagaggactctggaggatgaggaggaacaggagcgcgagcgcaggcggcggcaccgcaacctgagctccaccacggacgatgaggctcccaggctcagccagaatggagaccggcaggcctctgcttctgagagactaccgagcgtggaagaagcagaggtgcccaagccactgcccccagcctccaaagatgaggacgaggacatccagagcatcctcagaacacggcaggagcggaggcagaggcggcaggtggtggaggctgcacaggcccccatccaggagaggctggaggcagaggaggggaggaacagcttgagccctgtgcaggccacacagaaacccctagtctccaagaaggaactggaaatcccacctcgccggagactgagtcgggaacagcggggcccctgggccctggaggaggagagcttggtgggcagggagccagaagagaggaagaaaggggttccagaaaagtccccagtcttggagaagtcctccatgccaaagaagacggcacctgaaaagagcctggtctccgataaaacctccatctctgagaaggtgctggcctcagagaagacatctctatcagagaagatagcagtgtcagagaaaagaaacagctcagagaagaagtctgttctagaaaaaaccagtgtctctgagaagtcgctggccccagggatggcactgggctcaggaaggaggctggtgtctgagaaagcttccatctttgagaaggcactggcctcagagaagagcccaactgcagatgctaagccggccccaaagagggccacagcctcagagcagcccctggcgcaggagccgccagcctctgggggaagcccagccaccaccaaggagcagagaggaagggccctccctgggaagaacctgccctctttggcaaagcagggggcttcagaccctccgactgtggcctcccgcctcccacccgtcacactccaggtgaaaatccccagcaaggaggaagaggcagatatgtcctcacccacacagcgaacctacagcagctccctcaaacgctccagccccaggaccatctcctttcggatgaaacccaagaaagaaaactcggaaacaaccctaactcgcagtgccagcatgaagctcccagacaacacagtgaagttgggagagaagctggagagataccacacggccatacggagatcagaatctgtcaagtctcggggtctgccttgcactgagttattcgtggctcctgtgggtgtagccagcaagcgccacctctttgagaaggaactggcgggccagagccgagcagaaccagcctccagccggaaggagaacttgaggctctcaggggttgtgacatcaaggctcaacctgtggatcagcaggacccaggaatctggagatcaggacccccaggaggcacagaaagcatcatctgcaaccgagaggactcagtggggacagaaatctgactcctcgctggacgctgaggtgtgacaagccccgccaagacagacctgcaagtcttcgtctcaagggacctccctcatgccaggcccctgcctctcacagcagcaccctttcctctcattgtccctgttccctttttgcctgtggatctgtttggccagggtccctggggtcaggaatatttgcaagactcagccagctccttcccagcccagcctcttggggctgggactttctcaccctgcggcaggcacaacagatgctgggacccagtctctgcccaggtcacagcacaagtgcacatcagcactatggggcctatgtcctgcccagagacctctgctccttcctgctcacatccacagtcagggcacggcgcccctcaagaactccagagtcacctgtctcatcggctcccagcaagtgcctctttgtctatgatgtcccccttctctgaggcctggacccacccatctttgtccctggggcctgctcccagccactgaggcccgctctggccaggggagaaggagctgccgtgcgtcttccctgtgccccgtctccctgcttggttctcccctcccttccctggccggctgccatggccaggagctaagtgcctttttgtgtgcaaccacttaccctttctctgaaaaacctgttctcaggaaggatctgataaactcatttactctcaggtgtaagagactgatgagaccttagaagcgaattcctctctggaggccttgctttctagcagaggtcacctgaagtgtgtgaggaggatcatcattttcctcatcccccctcttctcacattaaggtggtggcttgccactcagcagtcctagcttggtgactgggaactgccacatacagggccaggcctaccctccttccccacaagccccctccaacccccacccccatgctctggacctcatggctcctatgagcttggagcatggtgaaccatcagagaatctagaaccaaccaagctaggaacatcagcctggtgccctgttaaccccttaaagctgtggtttacaacttttcaaaaatttaaatcattagaaaaaaaaaaaaaaaaaaaaaaaaaaaaaaaa

SEQ ID NO: 25 - DNA, 5039 bp, Homo sapiens
caagccgactgtgagccaggaagtgctcttggggagcccaggccaagccatccattcttgggtcctttggagggtagatatggattcccagtttctccagcggccagtgctccccctagtccacacagtgagaccgtgaaagcagatgctccggggcactcctgggcagcttttgctcagtggatgatgggtgactacagactccctgaccacccccagcccatggaaattctcaacctgtacttgggagacagcctggagccccacccaggagagtgcccaagggaaacgtgcagccatgaggatccaccggagcctttcgaggagcaaacctgggccactgaccctcctgaacctaccagacaaaatgttcctccctggggctccggtgtggagctcacacacctggggagctgggtccatcaggacgggctggagccttgccaggagcaaacccgggccactgaccctcctgaatctaccagacaagatgctcctccctggggctccggtgtggagctcacacacctggggagcccctctgcccagagggagcacaggcagaacacagcatcaccagggtcaccagtgaacagccatctaccggggagcccaaagcagaaccggagcacgtccacacaggtagtgttctgggcaggcatcctgcaggcccagatgtgtgtcctagacctggaggaggagctggagaagacggaagggctcaaggctgggctgaaatgctgtctccccacgccccctgtggacctccccggggacacgggcctgcactccagcccacctgagaatgaagactcaggggaagacagcagtgagcctgagggagagggccaggcatggctgagagagggaaccccagactcttccccacagtggggagctgaggaggagagcatgttcttcagcaaccccctcttcctggcgagtccttgctcagagaacagtgcttctggagagtgcttttcctggggggcttcagactcccatgcaggtgtgaggactggacctgagagcccagcgactctggagcctcccctcccagaagacacagtgctgtgggagctggaaagtgagccagatttgggggacggcgctgctatcagtgggcattgtacccctccattccctgtgcccatctataaaccacactccatctgctgggcctcagtggctgccgctgagggggctcctgcagcacctcctggtcacggggagagtgagggagataggcttggtcctgctccatctgcagcaccgtgtgtggacgaagcattgacctgggaatcaggatgtgtcggatctgatcttggccctgctgcacatcctgtgcaaccttgggcctctctcagccctgagggctggcagagaggaggtcctttttggccccaggtgactcttaactcccaggacagagatgagagggagggtggacacccccaggaatctcttccctgcaccttggccccctgcccctggaggagcccagcttcttctccagagcctagcagcccagaatctgagagcagaggccctggtcccaggcccagccctgcatcgtcccaggagggcagcccgcagcttcaacaccacagctcaggcattttgcccaagtggacactagatgcttcacagtcttcactcttggagacggatggggaacagccaagttccttgaagaaaaaggaggcaggggaggccccaaaaccaggcgaggaagtaaagagtgaaggaacagccaggcctgcagagactggagacgtccagcctgacattcacctgacttctgcagaacatgagaatctgaggacaccgatgaactcttcttggcttcctgggagccctatgccccaagcacagtccccagaggaaggccagagaccaccagctggagacaagctagctaatggcgtcaggaacaacaaggtagcctggaacttggcctcacgcctctatcgcctggagggcttccggaagtctgaagtggctgcctacctgcagaagaacaatgactttagcagggctgtggctgaggagtacctgtccttcttccagtttggaggccagagtctggaccgagccctccggagcttcctccaggccttggtgctcagtggggagactcaggaacgggagcgaatcctctaccagttctccagacgcttccaccattgcaatccggggatcttcccctcagtagattctgtacacaccttgacatgtgcaatcatgctgcttaacacggacctgcatggacagaacattgggaagagcatgagctgccaggaattcataaccaacctgaatgggctgagggatggcgggaacttccccaaggagctgctgaaggccctctactggtctatccgcagcgagaagctcgagtgggccgtggatgaagaagacacagccagacctgagaaggcccagccgtccctgccagctggcaagatgagcaagcccttccttcagctggctcaggatcccacagtgcccacctacaagcagggcatcctggctcggaaaatgcatcaagatgcagacggcaagaagacgccatggggcaagcgtggctggaagatgttccacaccttactgcgagggatggttctctacttcctgaagcagggagaagaccactgtctggagggggagagcttggtggggcagatggtggatgagcccgtgggggtgcaccactcgctggccacccccgccacgcattacaccaagaagccgcacgtcttccagctgcgcacggctgactggcgcctctacctcttccaggcacccactgccaaggagatgagctcctggatcgcgcgcatcaacttggctgcggccacgcactccgcgccgcccttccccgccgctgtgggctcccagcgcagattcgtgcggcccatcctgcccgtgggccccgcccagagctccctggaggagcagcatcgatcccacgagaactgcctggacgctgccgcggacgacctgctggatctacagaggaacctgccggagcggcggggccgtggccgcgagctggaggagcaccgcctgcggaaggagtacctggagtacgagaaaacccgctacgagacctacgtgcagctgctggtggcccgcctgcactgcccctctgatgctctggacctgtgggaggagcagctggggagggaagctggaggcactcgggagcccaagctcagcctgaagaagtcccactcgagcccgtccctgcaccaggatgaggctcccaccacggccaaggtgaagcgcaacatctcagagcgcagaacctaccggaagatcatccctaagcggaaccgcaatcagctgtgaagccagcaccacctcagagacactgttccctgctccagggtagacctgagatgaacctccctggaggagacttatttcaatgagtccaccatgacggatgaggcacctcctttccctgctgaaggacaaaccttgtttccctgtggccctcattcttgtgctccctgaagctttcctaatattgctgtgctccccaccacccccatggcagtccctccgcagccccagtccctggccacgcccaagggaagagggaggtgaggacttgactttcctcccagagctcagcccatgtcaccctccaggccccagaatccagagtggcctcatttcctagacttgctgagaactcagcacttgtttgagaaccagtgcttatgtggtgtgcccttggcttctgggggagagcttggggcagcagaggcccctgggcagcccagccaggggagccacagccccgaggatggtcttgctctgggaattaggtgaccttcctggggaggccccaggagagtgaatcagggactcttgagaaattcctaaccagcctcctgtgacccagggagcagggtcgctaaggtcctgcccactgaggggacagccttctgggcagggacctcggggggcttcaagggctctgcacggctgtggggccctgtgcctttgtctccttgtgtctcctttcccccgaagtagatgaaacagtctcacatacccaactgctcatcaacagagcagagctgatggcatgagtgagggctgggcggggtggggcctccagagctttgcagggaaccctggaaccctaggaacaaggagcctttgttccaacagagcagagaaggaggttctctatgttcagaccactggagaggatagagaggtaaaaggtggcgacagtttcccttaggggtctgcctggcaggagccacagctcaggagagttgtgagggatgggacggaggctggcgaccaggcgaggcctaggccaggctcgggagacttttctgtgctcctttctacacatgccttaaaccttccttcctgtggggtgcctggaccccttccccatctctggcagctcagagggtctctgctgctctcccctgggaaatcccctcatcctgccctctggctgcctcccagctgggcttgttctctgagggaggttccggagactcatggacttggggctctgcctgtaggaaggaggctgggccggagggaccagccaccattgtctctgttcagccaagtgtgcaagtaggctgcccgccaagagggggcctctgctacccgctgctgcctgccggctgacacactgcctccccagccttcctgctaggccaccctcctcccttcccatgcttgtaaccagctctggggcttgcacctccacaaagtaaggttggcccttggaggccatgtttgggtctccggccagggcctagggctaggccatgcacccaatgggtgcacaataaataacaggtcaacaaagagggaggtgtgtcagtgtgtgaggaagggaggtcaggcagctaggaccacctgcagtgtggcaggcttcatccctctttgctccaagtgtgtatgtgtgtctgtgcatgtgtgtagtgtctgtgtctgtgtgttcatgcatatgcaggagtcacacggtcataggccatcaaagctggaggaga

SEQ ID NO: 26 - DNA, 562 bp, Homo sapiens
  misc_feature (1)..(562): n = a,c,t, or g
gaaattcaggcgatttattgtaaacaggataaccctagcactccaccatactggctgtgtcacatgctccctctttcacatcaactggtcaaaaaagaagactttcttaagaagcctcaggtaactaataacttagttccacaaatctcatttactaagcactgcgtaaactgcagtatctggggtagtctgttattgctcatggactgcagcttggacccatctaaatgaatccattagtatgcctgagtgatcaacagcagctctagatccaacctggaaattggaaaatgctgacgcataccaaacaattgcaggttcatgggaagactacatgagattgctctcagatctcttcatgtgtcattctcataaaaaagacacttaaatttcacccattttttaaaaaagagctaaaagttactcaatagcacataattttccacataaaaggtaggtggatttttatttactagtacagtgggtggatcggnacactcaggcctaanttcagatctggtcctggtataacctgcaggtttaatggaaagctggcaagtct

SEQ ID NO: 27 - DNA, 3279 bp, Homo sapiens
ccggctcgaagcgcaacgaggaagcgtttgcggtgatcccggcgactgcgctggctaatgcggtaccggctagcgtggcttctgcaccccgcactgcccagcaccttccgctcagtcctcggcgcccgcctgccgcctccggagcgcctgtgtggtttccaaaaaaagacttacagcaaaatgaataatccagccatcaagagaataggaaatcacattaccaagtctcctgaagacaagcgagaatatcgagggctagagctggccaatggtatcaaagtacttcttatgagtgatcccaccacggataagtcatcagcagcacttgatgtgcacataggttcattgtcggatcctccaaatattgctggcttaagtcatttttgtgaacatatgctttttttgggaacaaagaaataccctaaagaaaatgaatacagccagtttctcagtgagcatgcaggaagttcaaatgcctttactagtggagagcataccaattactattttgatgtttctcatgaacacctagaaggtgccctagacaggtttgcacagttttttctgtgccccttgttcgatgaaagttgcaaagacagagaggtgaatgcagttgattcagaacatgagaagaatgtgatgaatgatgcctggagactctttcaattggaaaaagctacagggaatcctaaacaccccttcagtaaatttgggacaggtaacaaatatactctggagactagaccaaaccaagaaggcattgatgtaagacaagagctactgaaattccattctgcttactattcatccaacttaatggctgtttgtgttttaggtcgagaatctttagatgacttgactaatctggtggtaaagttattttctgaagtagagaacaaaaatgttccattgccagaatttcctgaacaccctttccaagaagaacatcttaaacaactttacaaaatagtacccattaaagatattaggaatctctatgtgacatttcccatacctgaccttcagaaatactacaaatcaaatcctggtcattatcttggtcatctcattgggcatgaaggtcctggaagtctgttatcagaacttaagtcaaagggctgggttaatactcttgttggtgggcagaaggaaggagcccgaggttttatgttttttatcattaatgtggacttgaccgaggaaggattattacatgttgaagatataattttgcacatgtttcaatacattcagaagttacgtgcagaaggacctcaagaatgggttttccaagagtgcaaggacttgaatgctgttgcttttaggtttaaagacaaagagaggccacggggctatacatctaagattgcaggaatattgcattattatcccctagaagaggtgctcacagcggaatatttactggaagaatttagacctgacttaatagagatggttctcgataaactcagaccagaaaatgtccgggttgccatagtttctaaatcttttgaaggaaaaactgatcgcacagaagagtggtatggaacccagtacaaacaagaagctataccggatgaagtcatcaagaaatggcaaaatgctgacctgaatgggaaatttaaacttcctacaaagaatgaatttattcctacgaattttgagattttaccgttagaaaaagaggcgacaccataccctgctcttattaaggatacagtcatgagcaaactttggttcaaacaagatgataagaaaaaaaagccgaaggcttgtctcaactttgaatttttcagcccatttgcttatgtggaccccttgcactgtaacatggcctatttgtaccttgagctcctcaaagactcactcaacgagtatgcatatgcagcagagctagcaggcttgagctatgatctccaaaataccatctatgggatgtatctttcagtgaaaggttacaatgacaagcagccaattttactaaagaagattattgagaaaatggctacctttgagattgatgaaaaaagatttgaaattatcaaagaagcatatatgcgatctcttaacaatttccgggctgaacagcctcaccagcatgccatgtactacctccgcttgctgatgactgaagtggcctggactaaagatgagttaaaagaagctctggatgatgtaacccttcctcgccttaaggccttcatacctcagctcctgtcacggctgcacattgaagcccttctccatggaaacataacaaagcaggctgcattaggaattatgcagatggttgaagacaccctcattgaacatgctcataccaaacctctccttccaagtcagctggttcggtatagagaagttcagctccctgacagaggatggtttgtttatcagcagagaaatgaagttcacaataactgtggcatcgagatatactaccaaacagacatgcaaagcacctcagagaatatgtttctggagctcttctgtcagattatctcggaaccttgcttcaacaccctgcgcaccaaggagcagttgggctatatcgtcttcagcgggccacgtcgagctaatggcatacagagcttgagattcatcatccagtcagaaaagccacctcactacctagaaagcagagtggaagctttcttaattaccatggaaaagtccatagaggacatgacagaagaggccttccaaaaacacattcaggcattagcaattcgtcgactagacaaaccaaagaagctatctgctgagtgtgctaaatactggggagaaatcatctcccagcaatataattttgacagagataacactgaggttgcatatttaaagacacttaccaaggaagatatcatcaaattctacaaggaaatgttggcagtagatgctccaaggagacataaggtatccgtccatgttcttgccagggaaatggattcttgtcctgttgttggagagttcccatgtcaaaatgacataaatttgtcacaagcaccagccttgccacaacctgaagtgattcagaacatgaccgaattcaagcgtggtctgccactgtttccccttgtgaaaccacatattaacttcatggctgcaaaactctgaagattccccatgcatgggaaagtgcaagtggatgcattcctgagtcttccagagcctaagaaaatcatcttggccactttaatagtttctgattcactattagagaaacaaacaaaaaattgtcaaatgtcattatgtagaaatattataaatccaaagtaa

SEQ ID NO: 28 - DNA, 573 bp, Homo sapiens
tagtcgcctgaggattttttattgtgttttccacatagataaaaaaataaggctttttgatgaaaagaatccattacaaagtcaaaaatccattacaattataattgaatcagtaacaaaatttagctttaaatgagtcaagtattctgcatttgaaatttaatatcacaaacattcaagattagtgaattttggtaagaaaaaaatactagaagaaaggaaaaggacaccttttcaacagatagtaatttataaaaatttttttaaaagtgctttgggaaaacacacagtatcattacttaagaaaagtcatttaaggaagacttaagtgcttcaagtggagtgtattacagactaaaaaatgttttaaaatttgccaagaaatttaagtgttaaaaatactcttctccttattcagtttcatgtttaaggaaacatttgacagacaagtaaaccaaacgcaaaaaaaagttcacctgcattttaaactaataaattctggatctgtaaaagctcttggtttgtacacagaggccaatgctgacatttattgatctatttttatgtagttaa

SEQ ID NO: 29 - DNA, 6256 bp, Homo sapiens
cgcgccgccgctcgctcacctgcgctcccgcccgcccctcggtgcgcgcccggcccgccagccgccgccgcccgcaccccgagcgccaccatgaactcgctcttcaggaagagaaacaaaggcaaatacagccccactgtgcagacccggagcatctctaacaaggagctctcggagctgatcgagcagctgcagaagaatgccgaccaggtggagaagaacatcgtggacacagaggccaagatgcagagtgacctggctcggctgcaggagggtcggcagcctgagcaccgggacgtgaccctgcagaaggtgttggactctgagaagctgctctatgtgctagaggcggatgcggccattgccaagcacatgaagcacccacagggggacatgatcgccgaggatatccgccagctgaaggagcgtgtgaccaacctgcgcgggaaacacaagcagatctacaggctggcggtgaaggaagtggatccacaggtcaactgggcggcactggtggaggagaagctggacaagctgaacaaccagagctttgggactgacctgccgctggtggaccaccaagtggaggagcataacatcttccacaatgaggtcaaggccatcgggccccacctggccaaggacggggacaaggagcagaacagcgaactccgggccaagtaccagaaactgctggcagcatcacaggcccggcagcagcacctgagttcgctgcaggactacatgcagcgctgcaccaatgagctgtactggctggaccagcaggccaagggccgcatgcagtacgactggagtgaccgcaacctcgactaccccagccgccggcgccagtatgagaatttcatcaaccggaacctggaggccaaagaggagagaatcaacaaactgcacagcgagggcgaccagctgctggcggccgagcaccccgggaggaactccattgaggcgcacatggaggctgtgcacgcagactggaaggagtacctgaacctgctcatctgcgaggagagccacctcaagtacatggaggactaccaccagtttcacgaagacgtgaaggacgctcaggagctgctgcgcaaggtggactcggacctgaaccagaagtatggccctgacttcaaggaccggtaccagattgagctgctgctgcgggagctggatgaccaggagaaggtgctggacaagtatgaggacgtggtgcaggggctgcagaagcgaggccagcaggtggtgcccctcaagtaccgccgggagactccgctcaagcccatccccgtggaggcactctgtgactttgagggggagcagggcctgatctcgcggggctacagctacaccctgcagaagaacaacggggagagctgggagctcatggacagcgctgggaacaagctgattgctccggccgtctgttttgtgatcccccccacagaccctgaggccctggctctggctgacagcctgggcagccagtaccggagcgtgcggcagaaggcagctgggagcaaacgcacgctgcagcagcggtatgaggtgctgaagaccgagaatcccggagatgcctctgacctacaggggcggcagctgctggctggcttggacaaggtggccagcgacctggaccggcaggagaaggccatcacagggatcctgcggccaccactggagcaaggccgggctgtgcaggacagtgccgagcgggccaaggacctcaagaacatcaccaacgagctactgcggattgaacctgagaagacgcggagcacggctgagggcgaagccttcatccaggccctcccaggcagtggcaccacacccctgctgaggacccgggtggaggacaccaaccggaaatacgagcacctcctgcagctgctggacttggcccaggagaaggttgatgtggccaaccgcctggagaagagcctgcagcagagctgggagttgctggccacacacgagaaccatctgaatcaggatgacacagtgcctgagagcagccgtgtcctggacagcaaggggcaggagctggcggccatggcctgtgagttacaggcccagaagtccctcctgggtgaggtggagcagaacttgcaggcggccaagcagtgctcgagcacactggccagccgcttccaggagcactgcccggacctggagcgccaggaggccgaggtgcacaagctgggccagcgtttcaacaacctgcgccagcaggtggaacgcagggcgcagagcctacagagcgccaaggcagcctacgagcacttccaccgcggccatgaccacgtgctgcagttcctagtcagcatccccagttacgagccccaggagacagacagcctcagccagatggagaccaagctgaagaaccagaagaacctgctagatgagatagcaagtagggagcaggaagtacagaagatctgtgccaattcccagcagtaccagcaagctgtaaaggactatgagttagaagcagaaaaactaaggtctcttctcgacttggagaatggaaggagcagccacgtgagcaagagagccaggctccaatctcctgccaccaaagtgaaggaagaggaagcagcacttgccgccaagttcactgaagtttatgccatcaacagacagaggctgcagaatctggagtttgctctgaatctcctcagacagcagccggaagtagaagtgacccatgagaccctgcaaaggaataggccggactctggagtggaggaggcgtggaagatcaggaaggaactggatgaggagactgagcggaggcggcagctggagaacgaggtcaagagcacccaggaagaaatctggaccttgaggaatcaggggcctcaggaatcggtggtgaggaaggaggtgctcaagaaggtgccggatcccgtgctggaggagagcttccagcagctgcagcggacgctggcagaggagcagcacaagaaccagctgctgcaggaggagctggaggcactgcagctgcagctgcgtgccctggagcaggagaccagagacggggggcaggagtacgtggtcaaggaggtcctgcgcatcgagcctgacagggcccaggcggatgaggtcttgcagctgcgggaggagctggaggcactgaggcggcagaagggcgcccgggaggcagaggtgctcctcctgcagcagcgtgtggccgccctggctgaagagaagagccgggcgcaggagaaggtcacagagaaagaggtggtgaaactgcagaatgacccccagctggaggcagagtaccagcagctgcaggaggaccaccagcgccaggaccagctcagggagaagcaggaggaggagctgagcttcctccaggacaagctcaagaggctagagaaggagcgggccatggccgagggcaagatcaccgtcaaggaggtgctcaaggtggagaaggacgcggccaccgagagggaggtcagcgatctcacccgccaatatgaggacgaggctgccaaggctcgcgctagccagagggagaagacggagctgctccgaaagatatgggccttggaggaggagaacgccaaagtggtggtgcaggagaaggtgcgggagatcgtgcggccagaccccaaggcggaaagtgaagtggcgaacctccgcctggagcttgtggagcaggagcgaaagtaccggggtgccgaggagcagctccggagctaccagagtgagctggaggccctcaggaggcgaggcccccaggtggaagtcaaagaggtgactaaggaagtcattaagtacaagactgaccctgagatggagaaggagcttcagcggctcagggaggagatcgtggacaagaccagactgatcgaaaggtgtgatttagagatctaccagctgaaaaaggaaatccaggccctgaaagacaccaaaccccaggtccagaccaaagaggtggtccaggagatcctccaattccaagaagaccctcaaaccaaggaggaggtggcgtctctgagggcaaagctctcagaggagcagaagaaacaagtggatctggagagggaaagagcttcccaggaagagcagatcgcccggaaagaggaggagctctcgcgggtgaaggaaagggtggtgcagcaggaggtggtcaggtatgaggaggagccaggcctgcgggccgaggcgagcgcctttgccgagagcatcgatgtggagctgcggcagattgacaagctgcgggcagagctgcggcggctgcagcgccggcgcaccgagcttgagcggcagctggaggagctagagcgcgagcggcaggcccgcagggaggccgagcgcgaggtacagcggttgcagcagcggctggcagcgctggagcaggaagaagctgaggcccgtgagaaggtaacccatacgcagaaggtggtgctgcagcaggacccgcagcaggcgcgagagcatgccctgctccgactccagctggaagaagagcagcaccggcggcagctcctggagggggagctcgagaccctccggaggaaactggctgcactggagaaggcggaggtcaaggagaaggtggtgctctccgagagtgtccaggtggagaagggcgacaccgagcaagagatccagaggctcaagagcagcctggaggaggagagccgcagcaagcgcgagctggacgtcgaggtgagccggctggaagccaggctttcggagctggaattccataactccaagtcatccaaggaactagactttctgagggaagagaaccacaaattacagctggagaggcaaaacctgcagctggagacccgaaggctccaatcggaaatcaacatggcagcgacggaaacacgagacctgcggaacatgaccgtggcggactctgggaccaaccatgactccagactgtggtccctggagagggaactggatgacctcaagaggctctccaaggacaaagacctcgagatcgacgagctgcagaagcgcctgggctccgtggccgtcaagcgggagcagcgggagaaccacctgcggcgctccatcgtagtcatccaccctgacacaggccgcgagctgtccccggaggaagcccaccgtgccgggctcattgactggaacatgttcgtgaaactcagaagccaggagtgcgactgggaggagatctcagtgaagggtcccaatggggagtcctcagtgatacacgacaggaagtctggcaagaagttctccatcgaagaggccctgcagagtggcaggctgacccctgctcagtatgaccgctatgtcaacaaggatatgtccatccaggagctggcggtcttggtatctgggcagaagtaggcacagctcttgcaactcttcgtaacggcagacgctggccctctcctacgacgcagtgacctccttggtgtcgtcctctccctagccctggtgcaggccaagcattttatacataccctcgctgccaggctgctcagagtcccgcccacatatgagacaggcactggctgaagacaggcaactctcgtcccaaccatcattcaccctgagtgacgtacttcatcctccaatgactggacaactgcgatgccttttcctcccttttcctgtacactcccagcaacaaactcctcatgataactgcacacaatctgaaaaccactgaaggacaagccaaccacagcagccaagcccactccttgcagcatgggtactggtggcacaccagacagtgacactgccccacaaaggcctgggcccgtgggggctgctgcctggcatgacatctctccagatttctggcttaaaaccaactttccatccgagaagcctcctcagtagttactctgctcatgagacagatctgggctccaagccaggaaaggtgaacagaaaccacaagtgtccagccctcggtgctggagtggacgttaattgtcagccaccagactgtcccggcacctacagagaatgtttcacagttctggcatttaaatcctttgatagtggattgtgctgctgttagccttagtttcagtgctttacaagtctcgcttattatctcattggtatttaggtatacaaaacagttgattattcaccacgccaatatctgggtctctgtatctcatgtagaacataagaaaatgggaactaatagggaaatttatttatagcatgaaaataaacctggtggctggagtctgcttgtacggtcaaaaaaaaaaaaaaaaaa

SEQ ID NO: 30 - DNA, 3448 bp, Homo sapiens
gactgggtcatccctccaatcaacttgccagaaaactccaggggaccttttcctcaagagcttgtcaggatcaggtctgatagagataaaaacctttcactgcggtacagtgtaactgggccaggagctgaccagcctccaactggtatcttcattctcaaccccatctcgggtcagctgtcggtgacaaagcccctggatcgcgagcagatagcccggtttcatttgagggcacatgcagtagatattaatggaaatcaagtggagaaccccattgacattgtcatcaatgttattgacatgaatgacaacagacctgagttcttacaccaggtttggaatgggacagttcctgagggatcaaagcctggaacatatgtgatgaccgtaacagcaattgatgctgacgatcccaatgccctcaatgggatgttgaggtacagaatcgtgtctcaggctccaagcaccccttcacccaacatgtttacaatcaacaatgagactggtgacatcatcacagtggcagctggacttgatcgagaaaaagtgcaacagtatacgttaataattcaagctacagacatggaaggcaatcccacatatggcctttcaaacacagccacggccgtcatcacagtgacagatgtcaatgacaatcctccagagtttactgccatgacgttttatggtgaagttcctgagaacagggtagacatcatagtagctaatctaactgtgaccgataaggatcaaccccatacaccagcctggaacgcagtgtacagaatcagtggcggagatcctactggacggttcgccatccagaccgacccaaacagcaacgacgggttagtcaccgtggtcaaaccaatcgactttgaaacaaataggatgtttgtccttactgttgctgcagaaaatcaagtgccattagccaagggaattcagcacccgcctcagtcaactgcaaccgtgtctgttacagttattgacgtaaatgaaaacccttattttgcccccaatcctaagatcattcgccaagaagaagggcttcatgccggtaccatgttgacaacattcactgctcaggacccagatcgatatatgcagcaaaatattagatacactaaattatctgatcctgccaattggctaaaaatagatcctgtgaatggacaaataactacaattgctgttttggaccgagaatcaccaaatgtgaaaaacaatatatataatgctactttccttgcttctgacaatggaattcctcctatgagtggaacaggaacgctgcagatctatttacttgatattaatgacaatgcccctcaagtgttacctcaagaggcagagacttgcgaaactccagaccccaattcaattaatattacagcacttgattatgacattgatccaaatgctggaccatttgcttttgatcttcctttatctccagtgactattaagagaaattggaccatcactcggcttaatggtgattttgctcagcttaatttaaagataaaatttcttgaagctggtatctatgaagttcccatcataatcacagattcgggtaatcctcccaaatcaaatatttccatcctgcgcgtgaaggtttgccagtgtgactccaacggggactgcacagatgtggacaggattgtgggtgcggggcttggcaccggtgccatcattgccatcctgctctgcatcatcatcctgcttatccttgtgctgatgtttgtggtatggatgaaacgccgggataaagaacgccaggccaaacaacttttaattgatccagaagatgatgtaagagataatattttaaaatatgatgaagaaggtggaggagaagaagaccaggactatgacttgagccagctgcagcagcctgacactgtggagcctgatgccatcaagcctgtgggaatccgacgaatggatgaaagacccatccacgccgagccccagtatccggtccgatctgcagccccacaccctggagacattggggacttcattaatgagggccttaaagcggctgacaatgaccccacagctccaccatatgactccctgttagtgtttgactatgaaggcagtggctccactgctgggtccttgagctcccttaattcctcaagtagtggtggtgagcaggactatgattacctgaacgactgggggccacggttcaagaaacttgctgacatgtatggtggaggtgatgactgaacttcagggtgaacttggtttttggacaagtacaaacaatttcaactgatattcccaaaaagcattcagaagctaggctttaactttgtagtctactagcacagtgcctgctggaggctttggcataggctgcaaaccaatttgggctcagagggaatatcagtgatccatactgtttggaaaaacactgagctcagttacacttgaattttacagtacagaagcactgggattttatgtgcctttttgtacctttttcagattggaattagttttctgtttaaggctttaatggtactgatttctgaaacgataagtaaaagacaaaatattttgtggtgggagcagtaagttaaaccatgatatgcttcaacacgcttttgttacattgcatttgcttttattaaaatacaaaattaaacaaacaaaaaaactcatggagcgattttattatcttgggggatgagaccatgagattggaaaatgtacattacttctagttttagactttagtttgttttttttttttttcactaaaatcttaaaacttactcagctggttgcaaataaagggagttttcatatcaccaatttgtagcaaaattgaattttttcataaactagaatgttagacacattttggtcttaatccatgtacacctttttatttctgtatttttccacttcactgtaaaaatagtatgtgtacataatgttttattggcatacgtctatggagaagtgcagaaacttcagaacatgtgtatgtattatttggactatggattcaggttttttgcatgtttatatctttcgttatggataaagtatttacaaaacagtgacatttgattcaattgttgagctgtagttagaatactcaatttttaatttttttaatttttttattttttattttctttttggtttggggagggagaaaagttcttagcacaaatgttttacataatttgtaccaaaaaaaaaaaaaaaggaaaggaaagaaaggggtggcctgacactggtggcactactaagtgtgtgtttttttaaaaaaaaaatggaaaaaaaaaagcctttaaactggagagacttctgacaacagctttgcctctgtattgtgtaccagaatataaatgatacacctctgaccccagcgttctgaataaaatgctaattttggataacaaaaaaaggggaattc

SEQ ID NO: 31 - DNA, 4122 bp, Homo sapiens
tttgtcatcagctcgctctccattggcggggagcggagagcagcgaagaagggggtggggaggggaggggaagggaagggggtggaaactgcctggagccgtttctccgcgccgctgttggtgctgccgctgcctcctcctcctccgccgccgccgccgccgccgccgcctcctccggctcttcgctcggcccctctccgcctccatgtgccggatagcgggagcgctgcggaccctgctgccgctgctggcggccctgcttcaggcgtctgtagaggcttctggtgaaatcgcattatgcaagactggatttcctgaagatgtttacagtgcagtcttatcgaaggatgtgcatgaaggacagcctcttctcaatgtgaagtttagcaactgcaatggaaaaagaaaagtacaatatgagagcagtgagcctgcagattttaaggtggatgaagatggcatggtgtatgccgtgagaagctttccactctcttctgagcatgccaagttcctgatatatgcccaagacaaagagacccaggaaaagtggcaagtggcagtaaaattgagcctgaagccaaccttaactgaggagtcagtgaaggagtcagcagaagttgaagaaatagtgttcccaagacaattcagtaagcacagtggccacctacaaaggcagaagagagactgggtcatccctccaatcaacttgccagaaaactccaggggaccttttcctcaagagcttgtcaggatcaggtctgatagagataaaaacctttcactgcggtacagtgtaactgggccaggagctgaccagcctccaactggtatcttcattatcaaccccatctcgggtcagctgtcggtgacaaagcccctggatcgcgagcagatagcccggtttcatttgagggcacatgcagtagatattaatggaaatcaagtggagaaccccattgacattgtcatcaatgttattgacatgaatgacaacagacctgagttcttacaccaggtttggaatgggacagttcctgagggatcaaagcctggaacatatgtgatgaccgtaacagcaattgatgctgacgatcccaatgccctcaatgggatgttgaggtacagaatcgtgtctcaggctccaagcaccccttcacccaacatgtttacaatcaacaatgagactggtgacatcatcacagtggcagctggacttgatcgagaaaaagtgcaacagtatacgttaataattcaagctacagacatggaaggcaatcccacatatggcctttcaaacacagccacggccgtcatcacagtgacagatgtcaatgacaatcctccagagtttactgccatgacgttttatggtgaagttcctgagaacagggtagacatcatagtagctaatctaactgtgaccgataaggatcaaccccatacaccagcctggaacgcagtgtacagaatcagtggcggagatcctactggacggttcgccatccagaccgacccaaacagcaacgacgggttagtcaccgtggtcaaaccaatcgactttgaaacaaataggatgtttgtccttactgttgctgcagaaaatcaagtgccattagccaagggaattcagcacccgcctcagtcaactgcaaccgtgtctgttacagttattgacgtaaatgaaaacccttattttgcccccaatcctaagatcattcgccaagaagaagggcttcatgccggtaccatgttgacaacattcactgctcaggacccagatcgatatatgcagcaaaatattagatacactaaattatctgatcctgccaattggctaaaaatagatcctgtgaatggacaaataactacaattgctgttttggaccgagaatcaccaaatgtgaaaaacaatatatataatgctactttccttgcttctgacaatggaattcctcctatgagtggaacaggaacgctgcagatctatttacttgatattaatgacaatgcccctcaagtgttacctcaagaggcagagacttgcgaaactccagaccccaattcaattaatattacagcacttgattatgacattgatccaaatgctggaccatttgcttttgatcttcctttatctccagtgactattaagagaaattggaccatcactcggcttaatggtgattttgctcagcttaatttaaagataaaatttcttgaagctggtatctatgaagttcccatcataatcacagattcgggtaatcctcccaaatcaaatatttccatcctgcgcgtgaaggtttgccagtgtgactccaacggggactgcacagatgtggacaggattgtgggtgcggggcttggcaccggtgccatcattgccatcctgctctgcatcatcatcctgcttatccttgtgctgatgtttgtggtatggatgaaacgccgggataaagaacgccaggccaaacaacttttaattgatccagaagatgatgtaagagataatattttaaaatatgatgaagaaggtggaggagaagaagaccaggactatgacttgagccagctgcagcagcctgacactgtggagcctgatgccatcaagcctgtgggaatccgacgaatggatgaaagacccatccacgctgagccccagtatccggtccgatctgcagccccacaccctggagacattggggacttcattaatgagggccttaaagcggctgacaatgaccccacagctccaccatatgactccctgttagtgtttgactatgaaggcagtggctccactgctgggtccttgagctcccttaattcctcaagtagtggtggtgagcaggactatgattacctgaacgactgggggccacggttcaagaaacttgctgacatgtatggtggaggtgatgactgaacttcagggtgaacttggtttttggacaagtacaaacaatttcaactgatattcccaaaaagcattcagaagctaggctttaactttgtagtctactagcacagtgcttgctggaggctttggcataggctgcaaaccaatttgggctcagagggaatatcagtgatccatactgtttggaaaaacactgagctcagttacacttgaattttacagtacagaagcactgggattttatgtgcctttttgtacctttttcagattggaattagttttctgtttaaggctttaatggtactgatttctgaaacgataagtaaaagacaaaatattttgtggtgggagcagtaagttaaaccatgatatgcttcaacacgcttttgttacattgcatttgcttttattaaaatacaaaattaaacaaacaaaaaaactcatggagcgattttattatcttgggggatgagaccatgagattggaaaatgtacattacttctagttttagactttagtttgttttttttttttcactaaaatcttaaaacttactcagctggttgcaaataaagggagttttcatatcaccaatttgtagcaaaattgaattttttcataaactagaatgttagacacattttggtcttaatccatgtacacttttttatttctgtatttttccacttcactgtaaaaatagtatgtgtacataatgttttattggcatagtctatggagaagtgcagaaacttcagaacatgtgtatgtattatttggactatggattcaggttttttgcatgtttatatctttcgttatggataaagtatttacaaaacagtgacatttgattcaattgttgagctgtagttagaatactcaatttttaatttttttaatttttttattttttattttctttttggtttggggagggagaaaagttcttagcacaaatgttttacataatttgtaccaaaaaaaaaaaaaaggaaaggaaagaaaggggtggcctgacactggtggcactactaagtgtgtgttttttaaaaaaaaaaatggaaaaaaaaaagcttttaaactggagagacttctgacaacagctttgcctctgtattgtgtaccagaatataaatgatacacctctgaccccagcgttctgaataaaatgctaattttggaaaaaaaaaaaaaaaaa

SEQ ID NO: 32 - DNA, 4471 bp, Homo sapiens
gcggaacgctagcggtgttggcgcggagtggaccccggctgcggcccctggcaatggcgccaccatcggtcccggagtcccagtgatgctctgtgccatagagcccccataacttcactactacgtgatagtaaatccccggcaaaaaccagcagcgccttgcaagcccacgccaccccaagcatcccaggactcttctgaaacgactccgggctaccagatcggccgtccagctggaatcaaccgatggaggctccgctgcaaactggaatggtgcttggcgtgatgatcggggccggagtggcggtggtggtcacggccgtgctcatcctcctggtggtgcggaggctgcgagtgccaaaaaccccagccccggatggcccccggtatcggttccggaagagggacaaagtgctcttctatggccggaagattatgcggaaggtgtcacaatccacctcctccctcgtggatacctctgtctccgccacctcccggccacgcatgaggaagaaactgaagatgctcaacattgccaagaagatcctgcgcatccagaaagagacgcccacgctgcagcggaaggagcccccgcccgcagtgctagaagctgacctgaccgagggcgacctggctaactcccatctgccctctgaagtgctttatatgctcaagaacgtccgggtgctgggccacttcgagaagccactcttcctggagctctgccgccacatggtcttccagcggctgggccagggtgactacgtcttccggccgggccagccagatgccagcatctacgtggtgcaggacgggctgctggagctctgtctgccagggcctgacgggaaggagtgtgtggtgaaggaagtggttcctggggacagcgtcaacagccttctcagcatcctggatgtcatcaccggtcaccagcatccccagcggaccgtgtctgcccgggcggcccgggactccacggtgctgcgcctgccggtggaagcattctccgcggtcttcaccaagtacccggagagcttggtgcgggtcgtgcagatcatcatggtgcggctgcagcgagtcaccttcctggcactgcacaactacctgggtctgaccaatgagctcttcagccacgagatccagcccctgcgtctgttccccagccccggcctcccaactcgcaccagccctgtgcggggctccaagagaatggtcagcacctcagctacagacgagcccagggagaccccagggcggccacccgatcccaccggggccccgctgcctggacctacaggggaccctgtgaagcccacatccctggaaaccccctcgccccctctgctgagccgctgcgtctccatgccaggggacatctcaggcttgcagggtggcccccgctccgacttcgacatggcctatgagcgtggccggatctccgtgtccctgcaagaagaggcctccggggggtccctggcagcccccgctcggacccccactcaggagcctcgtgagcagccggcaggcgcctgtgaatacagctactgtgaggatgagtcggccactggtggctgccctttcgggccctaccagggccgccagaccagcagcatcttcgaggcagcaaagcaggagctggccaagctgatgcggattgaggacccctccctcctgaacagcagagtcttgctgcaccacgccaaagctggcaccatcattgcccgccagggagaccaggacgtgagcctgcacttcgtgctctggggctgcctgcacgtgtaccagcgcatgatcgacaaggcggaggacgtgtgcctgttcgtagcgcagcccggggaactggtggggcagctggcggtgctcactggcgaacctctcatcttcacactgcgagcccaacgcgactgcaccttcctgcggatctccaagtccgacttctatgagatcatgcgcgcacagcccagtgtggtgctgagtgcggcgcacacggtggcagccaggatgtcgcccttcgtgcgccagatggacttcgccatcgactggactgcagtggaggcgggacgcgcgctgtacaggcagggcgaccgctccgactgcacttacatcgtgctcaatgggcggctgcgtagcgtgatccagcgaggcagtggcaagaaggagctggtgggcgagtacggccgcggcgacctcatcggcgtggtggaggcactgacccggcagccgcgagccacgacggtgcacgcggtgcgcgacacggagctggccaagcttcccgagggcaccttgggtcacatcaaacgccggtacccgcaggtcgtgacccgccttatccacctactgagccagaaaattctagggaatttgcagcagctgcaaggacccttcccagcaggctctgggttgggtgtgcccccacactcggaactcaccaacccagccagcaacctggcaactgtggcaatcctgcctgtgtgtgctgaggtccccatggtggccttcacgctggagctgcagcacgccctgcaggccatcggtccgacgctactccttaacagtgacatcatccgggcacgcctgggggcctccgcactggatagcatccaagagttccggctgtcagggtggctggcccagcaggaggatgcacaccgtatcgtactctaccagacggacgcctcgctgacgccctggaccgtgcgctgcctgcgacaggccgactgcatcctcattgtgggcctgggggaccaggagcctaccctcggccagctggagcagatgctggagaacacggctgtgcgcgcccttaagcagctagtcctgctccaccgagaggagggcgcgggccccacgcgcaccgtggagtggctaaatatgcgcagctggtgctcggggcacctgcacctgcgctgtccgcgccgcctcttttcgcgccgcagccctgccaagctgcatgagctctacgagaaggttttctccaggcgcgcggaccggcacagcgacttctcccgcttggcgagggtgctcacggggaacaccattgcccttgtgctaggcgggggcggggccaggggctgctcgcacatcggagtactaaaggcattagaggaggcgggggtccccgtggacctggtgggcggcacgtccattggctctttcatcggagcgttgtacgcggaggagcgcagcgccagccgcacgaggcagcgggcccgggagtgggccaagagcatgacttcggtgctggaacctgtgttggacctcacgtacccagtcacctccatgttcactgggtctgcctttaaccgcagcatccatcgggtcttccaggataagcagattgaggacctgtggctgccttacttcaacgtgaccacagatatcaccgcctcagccatgcgagtccacaaagatggctccctgtggcggtacgtgcgcgccagcatgacgctgtcgggctacctgcccccgctgtgcgaccccaaggacgggcacctactcatggatggcggctacatcaacaatctgccagcggacatcgcccgcagcatgggtgccaaaacggtcatcgccattgacgtggggagccaggatgagacggacctcagcacctacggggacagcctgtccggctggtggctgctgtggaagcggctgaatccctgggctgacaaggtaaaggttccagacatggctgaaatccagtcccgcctggcctacgtgtcctgtgtgcggcagctagaggttgtcaagtccagctcctactgcgagtacctgcgcccgcccatcgactgcttcaagaccatggactttgggaagttcgaccagatctatgatgtgggctaccagtacgggaaggcggtgtttggaggctggagccgtggcaacgtcattgagaaaatgctcacagaccggcggtctacagaccttaatgagagccgccgtgcagacgtgcttgccttcccaagctctggcttcactgacttggcagagattgtgtcccggattgagccccccacgagctatgtctctgatggctgtgctgacggagaggagtcagattgtctgacagagtatgaggaggacgccggacccgactgctcgagggatgaaggggggtcccccgagggcgcaagccccagcactgcctccgagatggaggaggagaagtcgattctccggcaacgacgctgtctgccccaggagccgcccggctcagccacagatgcctgaggacctcgacaggggtcaccccctccctcccacccctggactgggctgggggtggccccgtgggggtagctcactccccctcctgctgctatgcctgtgacccccgcggcccacacactggactgacctgccctgagcggggatgcagtgttgcactgatgacttgaccagcccctcccccaataaactcgcctcttggaaaaaaaaaaaaaaaaaaaaaaaaaaaaaaaaaaaaaaaaaa

SEQ ID NO: 33 - DNA, 2634 bp, Homo sapiens
acaggcacaggtgaggaactcaactcaaactcctctctctgggaaaacgcggtgcttgctcctcccggagtggccttggcagggtgttggagccctcggtctgccccgtccggtctctggggccaaggctgggtttccctcatgtatggcaagagctctactcgtgcggtgcttcttctccttggcatacagctcacagctctttggcctatagcagctgtggaaatttatacctcccgggtgctggaggctgttaatgggacagatgctcggttaaaatgcactttctccagctttgcccctgtgggtgatgctctaacagtgacctggaattttcgtcctctagacgggggacctgagcagtttgtattctactaccacatagatcccttccaacccatgagtgggcggtttaaggaccgggtgtcttgggatgggaatcctgagcggtacgatgcctccatccttctctggaaactgcagttcgacgacaatgggacatacacctgccaggtgaagaacccacctgatgttgatggggtgataggggagatccggctcagcgtcgtgcacactgtacgcttctctgagatccacttcctggctctggccattggctctgcctgtgcactgatgatcataatagtaattgtagtggtcctcttccagcattaccggaaaaagcgatgggccgaaagagctcataaagtggtggagataaaatcaaaagaagaggaaaggctcaaccaagagaaaaaggtctctgtttatttagaagacacagactaacaattttagatggaagctgagatgatttccaagaacaagaaccctagtatttcttgaagttaatggaaacttttctttggcttttccagttgtgacccgttttccaaccagttctgcagcatattagattctagacaagcaacacccctctggagccagcacagtgctcctccatatcaccagtcatacacagcctcattattaaggtcttatttaatttcagagtgtaaattttttcaagtgctcattaggttttataaacaagaagctacatttttgcccttaagacactacttacagtgttatgacttgtatacacatatattggtatcaaaagggataaaagccaatttgtctgttacatttcctttcacgtatttcttttagcagcacttctgctactaaagttaatgtgtttactctctttccttcccacattctcaattaaaaggtgagctaagcctcctcggtgtttctgattaacagtaaatcctaaattcaaactgttaaatgacatttttatttttatgtctctccttaactatgagacacatcttgttttactgaatttctttcaatattccaggtgatagatttttgttgttttgttaattaatccaagatttacaatagcacaacgctaaatcacacagtaactacaaaaggttacatagatatgaaaagattggcagaggccattgcaggatgaatcacttgtcacttttcttctgtgctgggaaaaataatcaacaatgtgggtctttcatgagcagtgacggatagtttagcttactatgtttcccccccaattcaatgatctataacaacagagcaaagtctatgctcatttgcagactggaatcattaagtaatttaataaaaaaattgtgaaacagcatattacaagtttgaaaattcagggctggtgaaaaaaatcaactctaaatgatgataattttgtacagttttatataaaactctgagaactagaagaaattattaactttttttcttttttaattctaattcacttgtttattttgggggaggaagactttggtatggagcaaagaaataccaaaactactttaaatggaataaaaccaactttattctttttttcccccatactggtagataaagcaaactttataagtgggctattgaaagaaaagttacaagcttaagatacagaagcatttgttcaaaggatagaaagcatctaaaagtttaggctcaagatcaatctttacagattgatattttcagtttttaatcgactggactgcagatgttttttcttttaacaaactggaattttcaaacagattatctgtatttaaatgtatagaccttgatatttttccaatactattttttaaaaaattgtatgatttacatatgaacctcagttctgaaattcattacatatctgtctcattctgccttttatactgtctaaaaaagcaaagttttaaagtgcaattttaaaactgtaaattacatctgaaggctatatatcctttaatcacattttatattttttcttcacaattctaacctttgaaaatattataactggatatttcttcaaacagatgtcctggatgatggtccataagaataatgaagaagtagttaaaaatgtatggacagtttttccggcaaaatttgtagcttatgtcttggctaaatagtcaaggggtaatatgggcctgttgtttagtgtctccttcctaaagagcacttttgtattgtaatttattttttattatgctttaaacactatgtaaataaacctttagtaataaagaattatcagttataaaaaaaaaaaaaaaaaaa

SEQ ID NO: 34 - DNA, 2623 bp, Homo sapiens
gaggaactcaactcaaactcctctctctgggaaaacgcggtgcttgctcctcccggagtggccttggcagggtgttggagccctcggtctgccccgtccggtctctggggccaaggctgggtttccctcatgtatggcaagagctctactcgtgcggtgcttcttctccttggcatacagctcacagctctttggcctatagcagctgtggaaatttatacctcccgggtgctggaggctgttaatgggacagatgctcggttaaaatgcactttctccagctttgcccctgtgggtgatgctctaacagtgacctggaattttcgtcctctagacgggggacctgagcagtttgtattctactaccacatagatcccttccaacccatgagtgggcggtttaaggaccgggtgtcttgggatgggaatcctgagcggtacgatgcctccatccttctctggaaactgcagttcgacgacaatgggacatacacctgccaggtgaagaacccacctgatgttgatggggtgataggggagatccggctcagcgtcgtgcacactgtacgcttctctgagatccacttcctggctctggccattggctctgcctgtgcactgatgatcataatagtaattgtagtggtcctcttccagcattaccggaaaaagcgatgggccgaaagagctcataaagtggtggagataaaatcaaaagaagaggaaaggctcaaccaagagaaaaaggtctctgtttatttagaagacacagactaacaattttagatggaagctgagatgatttccaagaacaagaaccctagtatttcttgaagttaatggaaacttttctttggcttttccagttgtgacccgttttccaaccagttctgcagcatattagattctagacaagcaacacccctctggagccagcacagtgctcctccatatcaccagtcatacacagcctcattattaaggtcttatttaatttcagagtgtaaattttttcaagtgctcattaggttttataaacaagaagctacatttttgcccttaagacactacttacagtgttatgacttgtatacacatatattggtatcaaaagggataaaagccaatttgtctgttacatttcctttcacgtatttcttttagcagcacttctgctactaaagttaatgtgtttactctctttccttcccacattctcaattaaaaggtgagctaagcctcctcggtgtttctgattaacagtaaatcctaaattcaaactgttaaatgacatttttatttttatgtctctccttaactatgagacacatcttgttttactgaatttctttcaatattccaggtgatagatttttgttgttttgttaattaatccaagatttacaatagcacaacgctaaatcacacagtaactacaaaaggttacatagatatgaaaagattggcagaggccattgcaggatgaatcacttgtcacttttcttctgtgctgggaaaaataatcaacaatgtgggtctttcatgagcagtgacggatagtttagcttactatgtttcccccccaattcaatgatctataacaacagagcaaagtctatgctcatttgcagactggaatcattaagtaatttaataaaaaaattgtgaaacagcatattacaagtttgaaaattcagggctggtgaaaaaaatcaactctaaatgatgataattttgtacagttttatataaaactctgagaactagaagaaattattaactttttttcttttttaattctaattcacttgtttattttgggggaggaagactttggtatggagcaaagaaataccaaaactactttaaatggaataaaaccaactttattctttttttcccccatactggtagataaagcaaactttataagtgggctattgaaagaaaagttacaagcttaagatacagaagcatttgttcaaaggatagaaagcatctaaaagtttaggctcaagatcaatctttacagattgatattttcagtttttaatcgactggactgcagatgttttttcttttaacaaactggaattttcaaacagattatctgtatttaaatgtatagaccttgatatttttccaatactattttttaaaaaattgtatgatttacatatgaacctcagttctgaaattcattacatatctgtctcattctgccttttatactgtctaaaaaagcaaagttttaaagtgcaattttaaaactgtaaattacatctgaaggctatatatcctttaatcacattttatattttttcttcacaattctaacctttgaaaatattataactggatatttcttcaaacagatgtcctggatgatggtccataagaataatgaagaagtagttaaaaatgtatggacagtttttccggcaaaatttgtagcttatgtcttggctaaatagtcaaggggtaatatgggcctgttgtttagtgtctccttcctaaagagcacttttgtattgtaatttattttttattatgctttaaacacgtatgtaaataaacctttagtaataaagaattatcagttataaaaaaaaaaaaaaaaaaa

SEQ ID NO: 35 - DNA, 698 bp, Homo sapiens
cggcagccagaagacgcggtcccgcaggtgctgcgccagcgagaggcggtacagcgcctccgcccgcaggctgtgcatctcccgggccaccttctggcagtgcgccagctcacggcgcagctcggccttgcgggcgggcgcggcgctgtgcggcaggtgggcctcgggcggctggggcgcctcggagggcggggccggcacgcctagctgggggcagcccttggcctggaagagctgcagcaccaggtccagcacgcgcccgttgacgcgccaggcgcagttgcccagttgggtgagggcgtccagtgcgccatgcagcgcggtgggcgggcaggtttccagcagctcctggtgctgcgtggcgccttccaccgtgcgcatcagcttggtggggctgagcaggaaggcaccagagtgcggcgatgtccagggcagcggggggcaaagcatgggtacatccaccgcctcgaaggtcagcgtgggctccgcggccttctccagcagctgcacgtaagccgggtgcggcttcatgatgccgatctgctggacgtagcggtacgaatacacgaggtagagcacggtgacaagccgagaggaacgatgcggcttgtccacgctgcatggcatctgcgtagcctgcaccatcatgtacgccagcatcttggtcacatcatcagcactgacagaggccatggctg

SEQ ID NO: 36 - DNA, 510 bp, Homo sapiens
caatataatagtatgttttattaagataaatcactattcttcttgtccatcaacatatactttttacatttttgcttaatttacaattcgagttaatattttgagaacgtaaggaaagacaaataggtaaatgtcttgttgaaagggttaagatactgacaggacataccttcctgttccatcctatataaaatccactcatgagttggatgccaagtatagatttctgaaactcataaccaccaatcacgataatgcaatcattaaaactcacaccattgcaaggaccaagtataaaatattctgctactattttagatacttcaaaaacatccactactttaagtgaaaagctttaaatggggcaatggctattggctttttaatggaaattaaagaagaatttttctattattctgtttcgatcaactattaacctttaggataattgttttatgtgaaaaaaattagaaatttttttaaagcaaaattagtactattggtttttat

SEQ ID NO: 37 - DNA, 4312 bp, Homo sapiens
cgaccgcggcggctggaaccctgattgctgtccttcaacgtgttcattatgaagttattagtaatacttttgttttctggacttataactggttttagaagtgactcttcctctagtttgccacctaagttactactagtatcctttgatggcttcagagctgattatctgaagaactatgaatttcctcatctccagaattttatcaaagaaggtgttttggtagagcatgttaaaaatgtttttatcacaaaaacatttccaaaccactacagtattgtgacaggcttgtatgaagaaagccatggcattgtggctaattccatgtatgatgcagtcacaaagaaacacttttctgactctaatgacaaggatcctttttggtggaatgaggcagtacctatttgggtgaccaatcagcttcaggaaaacagatcaagtgctgctgctatgtggcctggtactgatgtacccattcacgataccatctcttcctattttatgaattacaactcctcagtgtcatttgaggaaagactaaataatattactatgtggctaaacaattcgaacccaccagtcacctttgcaacactatattgggaagaaccagatgcaagtggccacaaatacggacctgaagataaagaaaacatgagcagagtgttgaaaaaaatagatgatcttatcggtgacttagtccaaagactcaagatgttagggctatgggaaaatcttaatgtgatcattacaagtgatcatgggatgacccagtgttctcaggacagactgataaacctggattcctgcatcgatcattcatactacactcttatagatttgagcccagttgctgcaatacttcccaaaataaatagaacagaggtttataacaaactgaaaaactgtagccctcatatgaatgtttatctcaaagaagacattcctaacagattttattaccaacataatgatcgaattcagcccattattttggttgccgatgaaggctggacaattgtgctaaatgaatcatcacaaaaattaggtgaccatggttatgataattctttgcctagtatgcatccatttctagctgcccacggacctgcatttcacaaaggctacaagcatagcacaattaacattgtggatatttatccaatgatgtgccacatcctgggattaaaaccacatcccaataatgggacctttggtcatactaagtgcttgttagttgaccagtggtgcattaatctcccagaagccatcgcgattgttatcggttcactcttggtgttaaccatgctaacatgcctcataataatcatgcagaatagactttctgtacctcgtccattttctcgacttcagctacaagaagatgatgatgatcctttaattgggtgacatgtgctagggcttatacaaagtgtctttgattaatcacaaaactaagaatacatccaaagaatagtgttgtaactatgaaaaagaatactttgaaagacaaagaacttagactaagcatgttaaaattattactttgttttccttgtgttttgtttcggtgcatttgctaataagataacgctgaccatagtaaaattgttagtaaatcattaggtaacatcttgtggtaggaaatcattaggtaacatcaatcctaactagaaatactaaaaatggcttttgagaaaaatacttcctctgcttgtattttgcgatgaagatgtgatacatctttaaatgaaaatataccaaaatttagtaggcatgtttttctaataaatttatatatttgtaaagaaaacaacagaaatctttatgcaatttgtgaattttgtatattagggaggaaaagcttcctatatttttatatttacctttaattagtttgtatctcaagtaccctcttgaggtaggaaatgctctgtgatggtaaataaaattggagcagacagaaaagatatagcaaatgaagaaatattttaaggaaacctatttgaaaaaaaaagcaaagaccatttgataaaagcctgagttgtcaccattatgtcttaagctgttagtcttaaagattattgttaaaaaattcagaagaaaagagagacaagtgctcttctctctatctatgcttaatgcctttatgtaagttacttagttgtttgcgtgtgcctgtgcaagtgtgtttgtgtgtggttgtgtggacattatgtgatttactatataaggaggtcagagatggactgtggccaggcttccacattcctgaagcacacagatctcaggaaaggttatttttgcacttcatatttgtttactttctcctaactcacaagttaaaatcataacttaatttcattaacttttatcatttaactctctcatgtttgttgtaacctgaggtatccaaatgctacagaaaaatttatgacccaaatacaaatctcaatttgactgggacagaatgaggaatggagatttttgtatttatctttgggactttatgccttactttttaggctatagaatagttaagaaattttaaacaaaatttagtatcttttggtctttcacaccattcatatgttaagtggcagaatagccttagtgctacctccactttttttctccagtatttgcatcacagaaataatccctctgtttaacatgtttgttcagagccaagggtttattgtgaagaactgtcatcctgcctttgctagctggtaccttctagtaatcaaaattaatatgaagaaactaggttgtgacagactagattatatttagtaggggaaaaattgggctcaagaaccattcatcagtacgtgagacaagcagttaatagtatgatctttaaagttttgacaatataaaataaacttggtaactgttttacaaatataaaagtataataaatatgcagcccagttaaatattgattatctgtgatggtaaagaacaacagtggtgccagtcatcaaacatacagtgcgtcctattgagtcactgctaatttcttgagcctggtatttgctgcctattgtatttgtggttgttgagaggcattttcaaaccctgtataaataatccatgctgttggtcataagttaactgtattaagaacagtaaaataaataaaaaccaatagtactaattttgctttaaaaaaatttctaatttttttcacataaaacaattatcctaaaggttaatagttgatcgaaacagaataatagaaaaattctactttaatttccattaaaaagcaaatagcattgacacatttaaagcttttcatttaaagtagtggatgtttttgaagtatctaaaatagtagcagaatattttatacttggtccttgcaatggtgtgagttttaatgattgcattatcgtgattggtggttatgagtttcagaaatctatacttggcatccaactcatgagtggattttatataggatggaacaggaaggtatgtcctgtcagtatcttaaccctttcaacaagacatttacctatttgtctttccttacgttctcaaaatattaactcgaattgtaaattaagcaaaaatttaaaaagtatatgttgatgggacaagaagaatagtatttatttaataaaacatatattatattgaactatgtgttaattcatttgtatcttttaaaaaattatcactgttaaagccattgactcctttagtacactgagaaaaatcttatagtaaaactagcctttcacattaaggttttggtgtgtattttgttaaataactaacatgctgctctattttctgggtgtagaaagtatttggctctaggaaacatttacttgtttgtgaaaacaataccccaaggtaataggaaaagtttgagttaagtgtttttaattcagtcagtgaattcagaataagtacattcatgtataacatagggacagttctgctgctgttatttatatgcaattcttctggtaaatagcaatagaataaaacatatttcaatgtttgtgtataggttttatattattattccactaggaatggcataagaatttatagataaattcttgtaacattaaaggattaaaatgtttttacattgtttttgggtgtctccttcttgtgcccatatctgataagctttatggattattgcatttaattccttttatttggagggttttacttccttgttaacatataaagttataaatgaaggacaaggaggagatggaaaatgtgtatttattgttaattcttaaaatagtgtgtaaataaaataacatcagtgtgcttt

SEQ ID NO: 38 - DNA, 4508 bp, Homo sapiens
cgggcagcgtggaccccggatgagttgcttttaggcttgctggcccgcggggctgtccaggcacgcgaggcccctcaggtacgccctctcttccctgcaggatccggccctcaaagacgagggtcacgcacgcgttacaaccccgaaacagtagcacaagatttaatttttaaaagagcgtgtttcttcggggcttgccgttcgttcgtttccagcctcaggaatttatggtcgcctttttgaatgagcaacaaaatgcttcaacaagttccagaaaacataaattttcctgctgaagaagagaaaatcttggagttttggactgaatttaattgttttcaggaatgcttaaagcaatcaaaacataaaccaaaatttaccttctatgatggtcctccttttgcaactggactgcctcactatggacatatacttgcgggtacaattaaagatatagttacaagatatgctcaccagagtgggtttcatgttgacagaagatttggatgggattgccatggcttacctgtggaatatgaaattgataagacactgggaatcagaggaccagaggatgtggccaaaatggggattacagagtataacaatcagtgccgagcaattgtgatgagatattctgctgagtggaagtctactgttagcagacttggccgatggattgactttgacaatgactataaaactctgtatccacaattcatggaatcagtctggtgggtcttcaaacaactctatgataaaggccttgtttatagaggtgtgaaagtcatgcccttctctacggcatgtaacactccactttccaacttcgagtcacaccagaattataaggatgttcaagatccttcagtatttgtaactttccctttggaagaagatgaaactgtatctttagttgcttggacaaccactccctggactctacctagtaaccttgctgtgtgtgttaatccagaaatgcaatatgtgaaaattaaagatgttgccagaggacgattactcattttaatggaagccagattgtcagccctctataaattggagagtgactatgagatccttgaaagatttcctggtgcctatcttaaaggcaagaagtacaggcccctgtttgactatttcctgaagtgtaaagagaatggcgctttcactgtgcttgttgacaactatgtgaaggaagaagaaggcacaggggttgtccaccaagctccttacttcggtgctgaggactatcgggtctgtatggactttaacattattcggaaagactcactccctgtttgccctgtggatgcttcaggctgcttcacaacggaggtgacagatttcgcaggacagtatgtgaaggatgctgacaaaagtatcatcaggactttgaaggaacaaggccgacttctggttgccaccaccttcactcacagctaccctttttgctggagatcagacactcctctaatttacaaagcagtgcccagctggtttgtgcgagtggagaacatggtggaccagctcctaaggaacaatgacctgtgctactgggtcccagagttggtacgagaaaaacgatttggaaattggctgaaagatgcacgtgactggacaatttccagaaacagatactggggcacccccatcccactgtgggtcagcgatgactttgaggaggtggtatgcattgggtcagtggcggaacttgaagaactgtcaggagcaaagatctcagatctccacagagagagtgttgaccacctgaccattccttcacgctgtgggaagggatccttgcaccgcatctctgaagtgtttgactgttggtttgagagtggcagcatgccctatgctcaggttcattacccgtttgaaaacaagagggagtttgaggatgcttttcctgcagatttcattgccgagggcatcgaccaaaccagaggatggttttataccctgctggtgctggccacggccctctttggacaaccgcctttcaagaacgtaattgtgaatgggcttgtcctggcaagtgatggccaaaaaatgagcaaacggaaaaagaattatccagatccagtttccatcatccagaagtatggtgctgatgccctcagattatatctgattaactcccctgtggtgagagcagaaaacctccgctttaaagaagagggtgtgcgggacgtccttaaggatgtactgctcccatggtacaatgcctatcgcttcttaatccagaacgttctgaggctccagaaggaggaagaaatagaatttctctacaatgagaacacggttagagaaagccccaacattacagaccggtggatcctgtccttcatgcagtctctcattggcttctttgagactgaaatggcagcttataggctttatactgtggtgcctcgcctggtcaagtttgtagatattctgaccaattggtatgttagaatgaaccgcagaagattaaagggtgaaaatgggatggaggattgtgtcatggccctagaaaccttgtttagtgttctgctttctctttgcagacttatagctccctacacaccttttctcactgaattgatgtaccagaatctaaaggtgctgattgaccctgtttctgttcaggacaaggacacactcagcattcactacctcatgctgccccgtgttcgagaagaattgattgacaagaaaacagagagtgcagtatctcagatgcagtctgtgattgaacttggaagagtgatcagagaccgaaaaactattcccataaagtatcctttgaaagaaattgtggttatccatcaagatccagaagctcttaaagatatcaagtctttggagaagtatatcattgaggaactcaatgttcgaaaagttacactgtctacagataaaaacaagtatggcattcggctaagggcagaaccagatcacatggtcctggggaagcgtctgaagggagcctttaaggcagtgatgacgtccatcaagcagttgagcagtgaggagctggagcagttccagaagactgggaccattgttgtggaaggccatgaattgcacgatgaagacatccgcctcatgtacacctttgatcaggccacaggtgggactgcgcaatttgaagcacactcagatgctcaggctttggtcctcttagatgtcactcctgaccagtcaatggtagatgaaggaatggctcgggaagtcatcaatcgcatacagaaacttcgcaaaaagtgcaatctggttccaactgatgaaatcacagtgtactataaagcaaagtctgaaggaacatatctgaatagtgttattgaaagccacacagagttcatatttaccaccataaaggctcccttgaaaccatatccagtttctccatcggataaagtccttattcaagaaaaaacacagttgaagggatctgaactggaaattacactcaccagaggatcttcccttcctggtcctgcttgtgcatatgtcaatcttaacatttgtgcaaatggcagtgaacaaggtggagtattgctcctggaaaatccaaaaggtgacaataggttggaccttttaaagctgaagagtgttgtcactagcatttttggtgtgaaaaatacagagctggctgtcttccatgatgaaacagaaatacaaaaccaaactgacttactgagtcttagtggaaaaacactttgtgtgactgcaggatcggctccctctctgatcaacagttctagtactcttctttgtcagtatatcaacctacagctcctgaatgcaaagccacaagagtgtttaatggggacagtgggcactctcctgcttgaaaacccacttgggcagaatggactcacccaccaaggtcttctgtatgaagcagccaaggtgtttggccttcggagcaggaagctaaagctgtttctgaatgagacccaaacgcaggaaattacagaagacatccccgtgaagactttgaatatgaagactgtgtatgtttctgtgttaccaacaacagcagacttctagcatgtacttatcaatgttgttcggtcagcccttccctaattacacctatcccctacacatacatgcacatagacacacacatgaacacactgaagatatttccttcaggtgtgtgtaaaatatgctgcttggattgaaattcaaatgggattgattagtcaagtaacttgagacctcacagtaatcttcacacttaaccttagacacctatgcagtcatgttgggagcaggttacaatgttacttcagcccacagtttatttctattcttgagttcttaagtacagaagatagaagtgatttaaatggcatagtatatatatcattttctggccttttaaaatttatttgagacctcttgatgaaatggacatattatatatttctgccacctggattttcctggataatttgatggaatattttaagtttcagtaaatcagaacaataaacaaactcagatat

SEQ ID NO: 39 - DNA, 2195 bp, Homo sapiens
actctttcttcggctcgcgagctgagaggagcaggtagaggggcagaggcgggactgtcgtctgggggagccgcccaggaggctcctcaggccgaccccagaccctggctggccaggatgaagtatctccggcaccggcggcccaatgccaccctcattctggccatcggcgctttcaccctcctcctcttcagtctgctagtgtcaccacccacctgcaaggtccaggagcagccaccggcgatccccgaggccctggcctggcccactccacccacccgcccagccccggccccgtgccatgccaacacctctatggtcacccacccggacttcgccacgcagccgcagcacgttcagaacttcctcctgtacagacactgccgccactttcccctgctgcaggacgtgcccccctctaagtgcgcgcagccggtcttcctgctgctggtgatcaagtcctcccctagcaactatgtgcgccgcgagctgctgcggcgcacgtggggccgcgagcgcaaggtacggggtttgcagctgcgcctcctcttcctggtgggcacagcctccaacccgcacgaggcccgcaaggtcaaccggctgctggagctggaggcacagactcacggagacatcctgcagtgggacttccacgactccttcttcaacctcacgctcaagcaggtcctgttcttacagtggcaggagacaaggtgcgccaacgccagcttcgtgctcaacggggatgatgacgtctttgcacacacagacaacatggtcttctacctgcaggaccatgaccctggccgccacctcttcgtggggcaactgatccaaaacgtgggccccatccgggctttttggagcaagtactatgtgccagaggtggtgactcagaatgagcggtacccaccctattgtgggggtggtggcttcttgctgtcccgcttcacggccgctgccctgcgccgtgctgcccatgtcttggacatcttccccattgatgatgtcttcctgggtatgtgtctggagcttgagggactgaagcctgcctcccacagcggcatccgcacgtctggcgtgcgggctccatcgcaacacctgtcctcctttgacccctgcttctaccgagacctgctgctggtgcaccgcttcctaccttatgagatgctgctcatgtgggatgcgctgaaccagcccaacctcacctgcggcaatcagacacagatctactgagtcagcatcagggtccccagcctctgggctcctgtttccataggaaggggcgacaccttcctcccaggaagctgagacctttgtggtctgagcataagggagtgccagggaaggtttgaggtttgatgagtgaatattctggctggcgaactcctacacatccttcaaaacccacctggtactgttccagcatcttccctggatggctggaggaactccagaaaatatccatcttctttttgtggctgctaatggcagaagtgcctgtgctagagttccaactgtggatgcatccgtcccgtttgagtcaaagtcttacttccctgctctcacctactcacagacgggatgctaagcagtgcacctgcagtggtttaatggcagataagctccgtctgcagttccaggccagccagaaactcctgtgtccacatagagctgacgtgagaaatatctttcagcccaggagagaggggtcctgatcttaaccctttcctgggtctcagacaactcagaaggttggggggataccagagaggtggtggaataggaccgccccctccttacttgtgggatcaaatgctgtaatggtggaggtgtgggcagaggagggaggcaagtgtcctttgaaagttgtgagagctcagagtttctggggtcctcattaggagcccccatccctgtgttccccaagaattcagagaacagcactggggctggaatgatctttaatgggcccaaggccaacaggcatatgcctcactactgcctggagaagggagagattcaggtcctccagcagcctccctcacccagtatgttttacagattacggggggaccgggtgagccagtgaccccctgcagcccccagcttcaggcctcagtgtctgccagtcaagcttcacaggcattgtgatggggcagccttggggaatataaaattttgtgaagacttgg

SEQ ID NO: 40 - DNA, 1219 bp, Homo sapiens
gaatagtctaccccccttgcactctacctgacacagctgcagcctgcaattcactcgcactgcctgggattgcactggatccgtgtgctcagaacaaggtgaacgcccagctgcagccatgaagatctgtagcctcaccctgctctccttcctcctactggctgctcaggtgctcctggtggaggggaaaaaaaaagtgaagaatggacttcacagcaaagtggtctcagaacaaaaggacactctgggcaacacccagattaagcagaaaagcaggcccgggaacaaaggcaagtttgtcaccaaagaccaagccaactgcagatgggctgctactgagcaggaggagggcatctctctcaaggttgagtgcactcaattggaccatgaattttcctgtgtctttgctggcaatccaacctcatgcctaaagctcaaggatgagagagtctattggaaacaagttgcccggaatctgcgctcacagaaagacatctgtagatattccaagacagctgtgaaaaccagagtgtgcagaaaggattttccagaatccagtcttaagctagtcagctccactctatttgggaacacaaagcccaggaaggagaaaacagagatgtcccccagggagcacatcaaaggcaaagagaccaccccctctagcctagcagtgacccagaccatggccaccaaagctcccgagtgtgtggaggacccagatatggcaaaccagaggaagactgccctggagttctgtggagagacttggagctctctctgcacattcttcctcagcatagtgcaggacacgtcatgctaatgaggtcaaaagagaacgggttcccttaagagatgtcatgtcgtaagtccctctgtatactttaaagctctctacagtccccccaaaatatgaacttttgtgcttagtgagtgcaacgaaatatttaaacaagttttgtattttttgcttttgtgttttggaatttgccttatttttcttggatgcgatgttcagaggctgtttcctgcagcatgtatttccatggcccacacagctatgtgtttgagcagcgaagagtctttgagctgaatgagccagagtgataatttcagtgcaacgaactttctgctgaattaatggtaataaaactctgggtgtttttcagaaatacattcaaaaaaaaaaaaaaaaaaaaaaaaaaaaaaaaaaaaaaaa

SEQ ID NO: 41 - DNA, 1876 bp, Homo sapiens
gagccatgctcgcggcgatgggctctctggcggctgccctctgggcagtggtccatcctcggactctcctactgggcactgtcgcctttctgctcgctgctgactttctcaaaagacggcgcccaaagaactacccgccggggccctggcgcctgcccttccttggcaacttcttccttgtggacttcgagcagtcgcacctggaggttcagctgtttgtgaagaaatatgggaacctttttagcttggagcttggtgacatatctgcagttcttattactggcttgcccttaatcaaagaagcccttatccacatggaccaaaactttgggaaccgccccgtgacccctatgcgagaacatatctttaagaaaaatggattgattatgtcaagtggccaggcatggaaggagcaaagaaggttcactctgacagcactaaggaactttggtttaggaaagaagagcttagaggaacgcattcaggaggaggcccaacacctcactgaagcaataaaagaggagaacggacagccttttgaccctcatttcaagatcaacaatgcagtttccaatatcatttgctccatcaccttcggagaacgctttgagtaccaggatagttggtttcagcagctgctgaagttactagatgaagtcacatacttggaggcttcaaagacatgccagctctacaatgtctttccatggataatgaaattcctgcctggaccccaccaaactctcttcagcaactggaaaaaactgaaattgtttgtttctcatatgattgacaaacacagaaaggattggaatcctgcagaaacaagagactttattgatgcttaccttaaagaaatgtcaaagcacacaggcaatcctacttcaagtttccatgaagaaaacctcatctgcagcaccctggacctcttctttgccggaaccgagacaacttccacaactctgcgatgggctctgctttatatggccctctacccagaaatccaagaaaaagtacaagctgagattgacagagtgattggccaggggcagcagccgagcacagccgcccgggagtccatgccctacaccaatgctgtcatccatgaggtgcagagaatgggcaacatcatccccctgaacgttcccagggaagtgacagttgataccactttggctgggtaccacctgcccaagggtaccatgatcctgaccaatttgacggcgctgcacagggaccccacagagtgggccacccctgacacattcaatccggaccattttctggagaatggacagtttaagaaaagggaagcctttatgcctttctcaataggaaagcgggcatgcctcggagaacagttggccaggactgagctgtttattttcttcacttcccttatgcaaaaatttaccttcaggcccccaaacaatgagaagctgagcctgaagtttagaatgggtatcaccatttccccagtcagtcaccgcctctgcgctgttcctcaggtgtaatattgttaagaaagaaaggggcaaggaaagtaagaagacatggcacgtgttctgaaaccactggtgtctgctcagatgtgttgggacaaaatgaaagtgactttcaagaaagatcagaggaatttgactcagagaaaactagatccaaatcccagctctactgtctcgtccgaattagccttgggaaaatcatttatatgctaaataatttacctttttatctaggagatgaaaagaggataatgtttccttccataaagaaagttcttgtaagaatcaaaagaaatggtgagctttaagtggtttgtaaaccataaaacacatcataaaagttctatctataaaaaaaaaaaaaaaaaaaa

SEQ ID NO: 42 - DNA, 4541 bp, Homo sapiens
ggatcctctagggtcccagctcgcctcgatggagctcctcccgccgctgcctcagtccttcctgttgctgctgctgttgcctgccaagcccgcggcgggcgaggactggcagtgcccgcgcaccccctacgcggcctctcgcgactttgacgtgaagtacgtggtgcccagcttctccgccggaggcctggtacaggccatggtgacctacgagggcgacagaaatgagagtgctgtgtttgtagccatacgcaatcgcctgcatgtgcttgggcctgacctgaagtctgtccagagcctggccacgggccctgctggagaccctggctgccagacgtgtgcagcctgtggcccaggaccccacggccctcccggtgacacagacacaaaggtgctggtgctggatcccgcgctgcctgcgctggtcagttgtggctccagcctgcagggccgctgcttcctgcatgacctagagccccaagggacagccgtgcatctggcagcgccagcctgcctcttctcagcccaccataaccggcccgatgactgccccgactgtgtggccagcccattgggcacccgtgtaactgtggttgagcaaggccaggcctcctatttctacgtggcatcctcactggacgcagccgtggctggcagcttcagcccacgctcagtgtctatcaggcgtctcaaggctgacgcctcgggattcgcaccgggctttgtggcgttgtcagtgctgcccaagcatcttgtctcctacagtattgaatacgtgcacagcttccacacgggagccttcgtatacttcctgactgtacagccggccagcgtgacagatgatcctagtgccctgcacacacgcctggcacggcttagcgccactgagccagagttgggtgactatcgggagctggtcctcgactgcagatttgctccaaaacgcaggcgccggggggccccagaaggcggacagccctaccctgtgctgcaggtggcccactccgctccagtgggtgcccaacttgccactgagctgagcatcgccgagggccaggaagtactatttggggtctttgtgactggcaaggatggtggtcctggcgtgggccccaactctgtcgtctgtgccttccccattgacctgctggacacactaattgatgagggtgtggagcgctgttgtgaatccccagtccatccaggcctccggcgaggcctcgacttcttccagtcgcccagtttttgccccaacccgcctggcctggaagccctcagccccaacaccagctgccgccacttccctctgctggtcagtagcagcttctcacgtgtggacctattcaatgggctgttgggaccagtacaggtcactgcattgtatgtgacacgccttgacaacgtcacagtggcacacatgggcacaatggatgggcgtatcctgcaggtggagctggtcaggtcactaaactacttgctgtatgtgtccaacttctcactgggtgacagtgggcagcccgtgcagcgggatgtcagtcgtcttggggaccacctactctttgcctctggggaccaggttttccaggtacctatccgaggccctggctgccgccacttcctgacctgtgggcgttgcctaagggcatggcatttcatgggctgtggctggtgtgggaacatgtgcggccagcagaaggagtgtcctggctcctggcaacaggaccactgcccacctaagcttactgagttccacccccacagtggacctctaaggggcagtacaaggctgaccctgtgtggctccaacttctaccttcacccttctggtctggtgcctgagggaacccatcaggtcactgtgggccaaagtccctgccggccactgcccaaggacagctcaaaactcagaccagtgccccggaaagactttgtagaggagtttgagtgtgaactggagcccttgggcacccaggcagtggggcctaccaacgtcagcctcaccgtgactaacatgccaccgggcaagcacttccgggtagacggcacctccgtgctgagaggcttctctttcatggagccagtgctgatagcagtgcaacccctctttggcccacgggcaggaggcacctgtctcactcttgaaggccagagtctgtctgtaggcaccagccgggctgtgctggtcaatgggactgagtgtctgctagcacgggtcagtgaggggcagcttttatgtgccacaccccctggggccacggtggccagtgtcccccttagcctgcaggtggggggtgcccaggtacctggttcctggaccttccagtacagagaagaccctgtcgtgctaagcatcagccccaactgtggctacatcaactcccacatcaccatctgtggccagcatctaacttcagcatggcacttagtgctgtcattccatgacgggcttagggcagtggaaagcaggtgtgagaggcagcttccagagcagcagctgtgccgccttcctgaatatgtggtccgagacccccagggatgggtggcagggaatctgagtgcccgaggggatggagctgctggctttacactgcctggctttcgcttcctacccccaccccatccacccagtgccaacctagttccactgaagcctgaggagcatgccattaagtttgagtatattgggctgggcgctgtggctgactgtgtgggtatcaacgtgaccgtgggtggtgagagctgccagcacgagttccggggggacatggttgtctgccccctgcccccatccctgcagcttggccaggatggtgccccattgcaggtctgcgtagatggtgaatgtcatatcctgggtagagtggtgcggccagggccagatggggtcccacagagcacgctccttggtatcctgctgcctttgctgctgcttgtggctgcactggcgactgcactggtcttcagctactggtggcggaggaagcagctagttcttcctcccaacctgaatgacctggcatccctggaccagactgctggagccacacccctgcctattctgtactcgggctctgactacagaagtggccttgcactccctgccattgatggtctggattccaccacttgtgtccatggagcatccttctccgatagtgaagatgaatcctgtgtgccactgctgcggaaagagtccatccagctaagggacctggactctgcgctcttggctgaggtcaaggatgtgctgattccccatgagcgggtggtcacccacagtgaccgagtcattggcaaaggccactttggagttgtctaccacggagaatacatagaccaggcccagaatcgaatccaatgtgccatcaagtcactaagtcgcatcacagagatgcagcaggtggaggccttcctgcgagaggggctgctcatgcgtggcctgaaccacccgaatgtgctggctctcattggtatcatgttgccacctgagggcctgccccatgtgctgctgccctatatgtgccacggtgacctgctccagttcatccgctcacctcagcggaaccccaccgtgaaggacctcatcagctttggcctgcaggtagcccgcggcatggagtacctggcagagcagaagtttgtgcacagggacctggctgcgcggaactgcatgctggacgagtcattcacagtcaaggtggctgactttggtttggcccgcgacatcctggacagggagtactatagtgttcaacagcatcgccacgctcgcctacctgtgaagtggatggcgctggagagcctgcagacctatagatttaccaccaagtctgatgtgtggtcatttggtgtgctgctgtgggaactgctgacacggggtgccccaccataccgccacattgacccttttgaccttacccacttcctggcccagggtcggcgcctgccccagcctgagtattgccctgattctctgtaccaagtgatgcagcaatgctgggaggcagacccagcagtgcgacccaccttcagagtactagtgggggaggtggagcagatagtgtctgcactgcttggggaccattatgtgcagctgccagcaacctacatgaacttgggccccagcacctcgcatgagatgaatgtgcgtccagaacagccgcagttctcacccatgccagggaatgtacgccggccccggccactctcagagcctcctcggcccacttgacttagttcttgggctggacctgcttagctgccttgagctaaccccaaggctgcctctgggccatgccaggccagagcagtggccctccaccttgttcctgccctttaactttcagaggcaataggtaaatgggcccattaggtccctcactccacagagtgagccagtgagggcagtcctgcaacatgtatttatggagtgcctgctgtggaccctgtcttctgggcacagtggactcagcagtgaccacaccaacactgacccttgaaccaataaaggaacaaatgactattaaagcacaaaaaaaaaa

SEQ ID NO: 43 - DNA, 720 bp, Homo sapiens
ggttcctgtgtgaccctgggcagttccttacctccctggtccccgtttgtcaaagaggatggactaaatgatctctgaaagtgttgaagcgcggacccttctgggtccaggaggggtccctgcaaaactccaggcaggacttctcaccagcagtcgtggggaacggaggaggacatggggaggttgtggggcctcaggctccgggcaccagggccaacctcaggctcctaaagagacattttccgcccactcctgggacactccgtctgctccaatgactgagcagcatccaccccaccccatctttgctgccagctctcaggaccgtgccctcgtcagctgggatgtgaagtctctgggtggaagtgtgtgccaagagctactcccacagcagccccaggagaaggggctttgtgaccagaaagcttcatccacagccttgcagcggctcctgcaaaaggaggtgaaagtccctgcctcaggccaagggaccaggtttgcaggagcccccctagtggtatggggctgagccctcctgagggccggttctaaggctcagactgggcactgggcctcagcctgctttcctgcagagtcgccaagcagacagccctggaaatgcctgactcagtgaacagtgcctgtgagcattgggggccaggaacggtctggtatacatggtgactcagcatcacccactttaagaaagaaaaaaacggc

SEQ ID NO: 44 - DNA, 1167 bp, Homo sapiens
ctggaaaatatgaggggccacccctctctgctgctgctatatatggcattaaccacctgcctggatacttcacccagtgaggagacagaccaagaagtcttcctgggtcccccagaggcccagagcttcctgagtagccatacccggattccaagagccaaccactgggacctggagctgctcacaccagggaacctggaacgggagtgtctggaagagaggtgttcctgggaagaggccagggagtattttgaggacaacactctcacggagcgcttttgggagagctacatctacaatggcaaaggagggcgtggacgagtggatgtggccagcctggctgtggggctgacaggtggcatcctgctcattgtcctggccggcctgggagccttttggtatctgcgctggcgacagcaccgaggccagcagccctgtccccaagaggccgggctcattagccctctgagtcctttgaaccctctgggcccaccgacgcccctgcctccacccccacccccacccccaggcctccccacctatgagcaggcgctggcagcctctggggtacacgacgcacctccacccccctacaccagcctcaggaggcctcactgaagagctgctttcgagacccggctctccgaaccgtgcccctgattcataccggattccggaagccgctaggcctcatagacgccgaagctggacttggagtggggaatggtgggagtaggggtcatccggcccgaggctgccctggcacacgcgtttccgccgcgtatggatatacacatgttttcggcaacgtgttcccgtgtcctggcccctcacgggcccccacactctcctgaccgtgagggcactggtcagttccgcccccgtggtaggcagacgcgcggggaaattcggacccaggagcccagccccggctgtgccatcttgtgtatgggcagatatgacctgacagccccctccagtgccacagggtacgcacacgcagagccccgcctgtgcacacgcgtgtcttcgtgcactccccgtgcggtacaggggcacttcgtaacccagggaaagggcggggggcatatttgcaagcgcgctcggtgcgggcaggctcgcattgcacccagggagctggagttgagctgttcccctaaataaaaa

SEQ ID NO: 45 - DNA, 2374 bp, Homo sapiens
acctggtgcgggaggcccgggcagggagaagtgtgcggggccgggacaagccggctccgagtgcggggcgggaggggcctgcgcggcggcgggagcccagagccgcgctaaagcgggtcaagcgtcctccttttctccccgccccttctcctcctcctacctgggcctctgcgtggagacgcgcacctggcaaccggaggccgcgtctccgccttctctgctcgcgcctggcgcccggagcctgcccgggacctccgccggagccgcgctcgctgcaggcggcctcgagcgctctctcgttgatgccgttttggaggtgaccggcgcggcggccgctctatggtggggccgcgttagtggctgcggctccgcgggactccagggcgcggctgcgaggtggcggggcgccccgcctgcagaaccctgcttgcagctcaggtttcggggtgcttgaggaggccgccacggcagcgcgggagcggaagatgttggagctgaggcaccggggaagctgccccggccccagggaagcggtgtcgccgccacaccgcgagggagaggcggccggcggcgaccacgaaaccgagagcaccagcgacaaagaaacagatattgatgacagatatggagatttggattccagaacagattctgatattccggaaattccaccatcctcagatagaacccctgagattctcaaaaaagctctatctggtttatcttcaaggtggaaaaactggtggatacgtggaattctcactctaactatgatctcgttgtttttcctgatcatctatatgggatccttcatgctgatgcttcttgttctgggcatccaagtgaaatgcttccatgaaattatcactataggttatagagtctatcattcttatgatctaccatggtttagaacactaagttggtactttctattgtgtgtaaactactttttctatggagagactgtagctgattattttgctacatttgttcaaagagaagaacaacttcagttcctcattcgctaccatagatttatatcatttgccctctatctggcaggtttctgcatgtttgtactgagtttggtgaagaaacattatcgtctgcagttttatatgttcgcatggactcatgtcactttactgataactgtcactcagtcacaccttgtcatccaaaatctgtttgaaggcatgatatggttccttgttccaatatcaagtgttatctgcaatgacataactgcttacctttttggatttttttttgggagaactccattaattaagttgtctcctaaaaagacttgggaaggattcattggtggtttcttttccacagttgtgtttggattcattgctgcctatgtgttatccaaataccagtactttgtctgcccagtggaataccgaagtgatgtaaactccttcgtgacagaatgtgagccctcagaacttttccagcttcagacttactcacttccaccctttctaaaggcagtcttgagacaggaaagagtgagcttgtaccctttccagatccacagcattgcactgtcaacctttgcatctttaattggcccatttggaggcttctttgctagtggattcaaaagagccttcaaaatcaaggattttgcaaataccattcctggacatggtgggataatggacagatttgattgtcagtatttgatggcaacttttgtacatgtgtacatcacaagttttatccggggcccaaatcccagcaaagtgctacagcagttgttggtgcttcaacctgaacagcagttaaatatatataaaaccctgaagactcatctcattgagaaaggaatcctacaacccaccttgaaggtataactggatccagagagggaaggactgacaagaaggaattattcagaaaaacactgacagatgttttataaattgtacagaaaaatagttaaaaatgcaataggttgaagttttggagatatgtttctctctgaaattactgtgaatatttaacaaacacttacttgatctatgttatgaaataagtagcaaattgccagcaaaatgtcttgtaccttttctaaagtgtattttctgatgtgaacttccttccccttacttgctaggtttcataatttaaaagagtcaaacactataaaatgagtaagttgacgatgttttaagattgcacctggcagtgtgcctttttgcacaaatatttacttttgcacttggagctgcttttaattttagcaaaatgttttatgcaaggcacaataggaagtcagttctcctgcacttcctcctcatgtagtctggagtactttctaaagggcttagttggatttaaaaaaaaaaaaaaaaaa

SEQ ID NO: 46 - DNA, 963 bp, Homo sapiens
gacacgaagcctcccgggtggcttacagacgctgccagcatcgccgccgccagaggagaaatgtctgaagtaagacccctctccagagacatcttgatggagaccctcctgtatgagcagctcctggaacccccgaccatggaggttcttggcatgactgactctgaagaggacctggaccctatggaggacttcgattctttggaatgcatggagggcagtgacgcattggccctgcggctggcctgcatcggggacgagatggacgtgagcctcagggccccgcgcctggcccagctctccgaggtggccatgcacagcctgggtctggctttcatctacgaccagactgaggacatcagggatgttcttagaagtttcatggacggtttcaccacacttaaggagaacataatgaggttctggagatccccgaaccccgggtcctgggtgtcctgcgaacaggtgctgctggcgctgctgctgctgctggcgctgctgctgccgctgctcagcgggggcctgcacctgctgctcaagtgaggccccggcggctcagggcggggctggccccacccccatgaccactgccctggaggtggcggcctgctgctgttatctttttaactgttttctcatgatgcctttttatatttaaaccccgagatagtgctggaacactgctgaggttttatactcaggttttttgttttttttttattccagttttcgttttttctaaaagatgaattcctatggctctgcaattgtcaccggttaactgtggcctgtgcccaggaagagccattcactcctgcccctgcccacacggcaggtagcagggggagtgctggtcacacccctgtgtgatatgtgatgccctcggcaaagaatctactggaatagattccgaggagcaggagtgctcaataaaatgttggtttccagcaaaaaaaaaaaaaa

SEQ ID NO: 47 - DNA, 1408 bp, Homo sapiens
ctctcgagcctgctgcctgctcccccgccccaccagccatggtggtttctggagcgcccccagccctgggtgggggctgtctcggcaccttcacctccctgctgctgctggcgtcgacagccatcctcaatgcggccaggatacctgttcccccagcctgtgggaagccccagcagctgaaccgggttgtgggcggcgaggacagcactgacagcgagtggccctggatcgtgagcatccagaagaatgggacccaccactgcgcaggttctctgctcaccagccgctgggtgatcactgctgcccactgtttcaaggacaacctgaacaaaccatacctgttctctgtgctgctgggggcctggcagctggggaaccctggctctcggtcccagaaggtgggtgttgcctgggtggagccccaccctgtgtattcctggaaggaaggtgcctgtgcagacattgccctggtgcgtctcgagcgctccatacagttctcagagcgggtcctgcccatctgcctacctgatgcctctatccacctccctccaaacacccactgctggatctcaggctgggggagcatccaagatggagttcccttgccccaccctcagaccctgcagaagctgaaggttcctatcatcgactcggaagtctgcagccatctgtactggcggggagcaggacagggacccatcactgaggacatgctgtgtgccggctacttggagggggagcgggatgcttgtctgggcgactccgggggccccctcatgtgccaggtggacggcgcctggctgctggccggcatcatcagctggggcgagggctgtgccgagcgcaacaggcccggggtctacatcagcctctctgcgcaccgctcctgggtggagaagatcgtgcaaggggtgcagctccgcgggcgcgctcaggggggtggggccctcagggcaccgagccagggctctggggccgccgcgcgctcctagggcgcagcgggacgcggggctcggatctgaaaggcggccagatccacatctggatctggatctgcggcggcctcgggcggtttcccccgccgtaaataggctcatctacctctacctctgggggcccggacggctgctgcggaaaggaaaccccctccccgacccgcccgacggcctcaggccccgcctccaaggcatcaggccccgcccaacggcctcatgtccccgcccccacgacttccggccccgccccgggccccagcgcttttgtgtatataaatgttaatgatttttataggtatttgtaaccctgcccacatatcttatttattcctccaatttcaataaattatttattctccaaaaaaaaaaaaaaaaaaaaaaaaaataaaaaaaaaaacaaaaaaaaaaaaaaa

SEQ ID NO: 48 - DNA, 3600 bp, Homo sapiens
gaatcaacagaatttgtctttttgtgactggtttatttcacttaacttcatcctcaaggttcaacttaaaggtgtatccatgttgtagcacgtgtcagcattttctttcgttctcaggctaaatagtatttcattgtgtgtgtacaccatgtttcatgcattcattcatcccttgaaagattggtgggttgtttcctcctttttgcttttgtgaacagtgctacgaacatggttgtacaaacatctcttggagccccactagcagttcctttgggtatataccccaaagtggaattgctggatctggtagctccctttttaattttttgaggaatcgccacacagtttccataacagctgcaccattttacattcccaagaccttttttttttttttttttttaagaagaaaagatgtgtttctgcatttctggaagtctatgctgcatttccatttgttgaaatttaagaccagagtcatcttttctgctgtaattataatggtcactggcttgtgccttttcctcctctctctgccccatctgcacggggtctttgaacaagtcccagcaccttggtggacaagcctgtgtccctggcccatcatggaagccgctgcctttcagagtgggagtctgtaccctgttgcctcattccttgctgcgcccatgagtgagcttgtgcctgacctctccttccaggtggacttacacactgggctgtcggagttctcggtgacgcagcgccggctggcccatggctggaatgagtttgttgctgacaacagcgaacctgtgtggaagaaatacctggatcagtttaagaaccccctgatcctgctgctgctgggctctgccctggtgagtgtcctcaccaaggagtatgaggacgccgtcagcatcgccacggcagtgcttgtcgtggtcactgtcgccttcatccaggagtacaggtcggagaaatctctggaagagctgaccaagctggttcctccagaatgtaactgcctaagagaaggaaaactccagcacctgcttgctcgagaactggttcctggtgatgtcgtatctctctcgatcggagaccggatccctgcagacatccgactcactgaggtcacggacctcttggtggatgaatccagtttcaccggggaagccgagccatgtagtaaaacagacagccccttgacaggcggtggggacctcaccaccctcagcaacatcgtcttcatggggaccctggtgcagtatgggaggggccagggggtcgtgattggaacaggggaaagctctcagttcggagaagtgtttaagatgatgcaggctgaagagacacctaaaactcctttgcagaaaagcatggacaggctaggaaagcaactgacactcttctcctttggcataatcggtctcatcatgctcattggctggtcgcaagggaaacaactcctgagtatgttcacgatcggggtcagcctggctgtggcggctattccagagggtctgcccatcgtcgtcatggtgacgctggtcctgggagtgctgcggatggccaagaagcgggtcatcgtgaagaagttacccatcgtggagactttaggttgctgcagcgttctctgttctgacaagacggggactctgactgccaatgaaatgacagtgacccagcttgtaacgtcagatgggcttcgtgccgaggtcagcggagttgggtatgacggtcaagggactgtgtgtcttctaccatccaaggaagtcattaaggaattttccaatgtctcagtgggaaagttagtggaggcgggctgtgttgccaacaatgcggtcatcagaaagaacgccgtgatggggcagcccaccgagggtgcattgatggccctggcgatgaagatggacttaagtgatattaaaaattcatatataagaaaaaaagagattccattcagttcagagcagaagtggatggcggtgaaatgcagtctgaagactgaggatcaggaagacatttacttcatgaaaggggccttggaagaggtgatccgctactgcaccatgtacaacaacgggggcatccccctgccgctgacgccccagcagaggtcattctgcctgcaggaagagaagaggatggggtcgctcggtttgcgggtgctggccctggcttctgggcccgagctggggcggctgacgtttctaggtcttgtgggcatcattgaccccccgagagttggcgtgaaggaagcagtccaggttctctccgagtctggtgtgtctgtgaagatgataacgggggatgccctggagacggccttggccataggaagaaacatcggcctgtgcaacgggaagctgcaagccatgtccggggaggaggtggacagcgtggagaagggcgagctggccgaccgcgtggggaaggtgtccgtgttcttcaggaccagcccaaagcacaagctcaaaatcatcaaggctctgcaggagtcaggggcgatcgtggccatgactggggatggggtgaacgacgcagtggccctgaagtctgcagacattgggatcgccatggggcagacagggacggacgtcagcaaagaggccgccaacatgatcctggtggatgatgacttctcagccatcatgaatgcagtggaggaaggcaagggtattttttacaacatcaaaaactttgtccgattccagctgagcacgagcatctccgccctgagtctcatcactctgtccaccgtgttcaacctgcccagccccctcaacgccatgcagatcctatggatcaacatcatcatggatgggccaccggcgcagagcttgggggtagagcccgttgacaaagacgccttcaggcagccaccacggagtgtgcgggacaccatcctcagcagagccctcatcctgaagatcctcatgtccgcggccatcatcatcagcgggaccctctttatcttctggaaggagatgcctgaagacagagcaagcactccccgcaccacgacgatgacgttcacttgttttgtgtttttcgatctcttcaacgccttgacctgccgctctcagaccaagctgatatttgagatcggctttctcaggaaccacatgttcctctactccgtcctggggtccatcctggggcagctggcggtcatttacatccccccgctgcagagggtcttccagacggagaacctgggagcgcttgatttgctgtttttaactggattggcctcatccgtcttcattttgtcagagctcctcaaactatgtgaaaaatactgttgcagccccaagagagtccagatgcaccctgaagatgtgtagtggaccgcactccgcggcaccttccctaatcatctcgatctggttgtgactgtggcccctgccgtgtctcctcgtcaggggagacttttaggaggccgcagccttccatcaccggatcagtttttcctcttaggaaagctgcaggaacctcgtgggctccagggacccaggcccacatccatccagcgttcccgctggctgtgggacagacagggaggggcctgtacagaaacaccacactgtttattaaatcacaatgatttttatt

SEQ ID NO: 49 - DNA, 2381 bp, Homo sapiens
cactgaataaactctaggttcccatttctttcagccagatcctcccagggaatcactacaggctggttagccaaaaagtcctgattttctgctcaatagaggtccttactggaaggcagcatgtccaatgttaccttgagaaaaatgtctcccacaggaaatgagatgaagagcaccactcagggaaccacacggaagcagcaggattttcacgaggtgaacaaaagaagaactttcttacaggataacagttggataaagaaacgccctgaagaagaaaaagatgaaaattacggtagggtggtgctcaaccgacataattcccatgatgcattggacaggaaagtaaatgagagagatgtgccaaaagctacaattagtcggtacagttctgatgacactttggacaggatctcagacagaaatgatgctgctaaaacatataaggccaataccttggataaccaactaaccaataggagcatgtccatgtttagatcactggaagtaacaaagttgcaacctggcggttcattgaatgccaacacctccaacaccatagcatccacttctgctactactcctgtaaagaagaagaggcagtcctggtttccaccgccccctccaggttacaatgcctcttcgagcacaggaaccaggagacgggaaccaggtgttcaccctccaatacctccaaagcccagttctcctgtttcttctcctaaccagctgagacaggataataggcagatacatccacctaaaccaggtgtatatacagaaaccaacagatctgctgaaagaaatataagtgaagaattggataatctcatcaaaatgaacaaaagcttgaataggaatcaaggtcttgatagtctcttcagagcaaatccaaaggtagaagaaagagagaaaagagccaaaagccttgaaagtctcatctatatgagtacccggacagataaagatggcaaaggaatccaaagccttggaagtccgattaaagttaatcaaaggactgacaaaaatgagaaaggaagacaaaatctcgaatctgttgctaaagtgaatgccaggatgaataaaacgagcagaagaagtgaagaccttgataatgctactgaagtaaatcccaaaggacatgaaaataccactggaaaaaaagaccttgatgggcttattaaagtggatcctgaaacaaataaaaatattacgaggggccagagccttgataatctcatcaaagtgacccctgaagtaaagagaagtaaccaaggttccaaagaccttaataacttcatcaaagtgtatccaggaacagaaaaaagtactgaagggggccaaagtctcgacagcctcattaaagtgactcctgaaagaaacagaactaaccaagggaaccaagacttggaaaatcttatcaaagtgatcccttcagcaaacaaaagcagtgaacaaggtcttgatgaacatattaatgtcagccccaaagctgtcaaaaacactgatggaaaacaagatcttgataaactcatcaaggtgaatcctgaaattttcacaaacaaccaaagaaaccaagatcttgctaacctcatcaaagtaaatcctgcagtaatcagaaacaatcagagccaagacttggaaaatcttatcaaagtgatcccttcagctcttagaaacactaatcgagaccagaacctggaaaatttaattgaagtaaattctcatgtgtctgaaaacaagaatggaagctctaacactggagccaagcaggcaggaccacaggatactgttgtgtacacaaggacatatgtggagaatagtaaatcacccaaggatggatatcaggagaatatctctggaaaatacatacaaactgtttattcaacttctgataggtctgtcattgaaagagatatgtgcacttactgccgaaaacccttgggtgtagaaactaaaatgattttagatgaattacaaatttgctgccattctacttgctttaagtgtgaaatatgcaagcagcctttggaaaatctacaagcgggtgatagtatttggatttatagacagacaatacactgtgaaccttgctactctaaaattatggcaaagtggattccataactctggcacaaggaaatcaagatgaaaagcactcattaaggaattaaagttacaagttttatcttaataatatgtaatctagaaaagctttcacattgaagatcaactcttgtacaaaattaacaattctgttattgcataagtaatctaattgtcttcaataaggtcacacacataaaaagagccatctggtctctggctagagttagcaataaaaagttcaaatggttccagaaaaaaaaaaaaaaaaaaaa

SEQ ID NO: 50 - DNA, 2393 bp, Homo sapiens
gagagagcgagacctgggagggaggggtcctccagcagaaaggggcgggggaaaaggtgcaaaagcagcgtgggagcgccgggctggcttcctgcggctgctgctggtctgactgggaagcagcaagccaccactacgaactctcaagaggagtgggagtgcgggagtccagagctgcctctgggaagtctgcagtagttgagcaaaggggtcctcacgttcctgagagctgggcaggggggattttggaacctggggcagccaagaacgagcagccaagggtacgggagattagttgtgcacagagcagtgctagtcgggcttgggggtggctggtgggcactgcgtgggaaaccttggtttgtagttttcttggtttgcgttactcctgttgggtagaattaccctccgcgcctttgtacaagacacggtgtctcctggggcaaggaaggagccaggatggcctgggctctgaagctgcctctggccgacgaagtgattgaatccgggttggtgcaggactttgatgctagcctgtccgggatcggccaggaactgggtgctggtgcctatagcatgagtgatgtccttgcattgcccatttttaagcaagaagagtcgagtttgcctcctgataatgagaataaaatcctgccttttcaatatgtgctttgtgctgctacctctccagcagtgaaactccatgatgaaaccctaacgtatctcaatcaaggacagtcttatgaaattcgaatgctagacaataggaaacttggagaacttccagaaattaatggcaaattggtgaagagtatattccgtgtggtgttccatgacagaaggcttcagtacactgagcatcagcagctagagggctggaggtggaaccgacctggagacagaattcttgacatagatatcccgatgtctgtgggtataatcgatcctagggctaatccaactcaactaaatacagtggagttcctgtgggaccctgcaaagaggacatctgtgtttattcaggtgcactgtattagcacagagttcactatgaggaaacatggtggagaaaagggggtgccattccgagtacaaatagataccttcaaggagaatgaaaacggggaatatactgagcacttacactcggccagctgccagatcaaagttttcaagcccaaaggtgcagacagaaagcaaaaaacggatagggaaaaaatggagaaacgaacacctcatgaaaaggagaaatatcagccttcctatgagacaaccatactcacagagtgttctccatggcccgagatcacgtatgtcaataactccccatcacctggcttcaacagttcccatagcagtttttctcttggggaaggaaatggttcaccaaaccaccagccagagccaccccctccagtcacagataacctcttaccaacaaccacacctcaggaagctcagcagtggttgcatcgaaatcgtttttctacattcacaaggcttttcacaaacttctcaggggcagatttattgaaattaactagagatgatgtgatccaaatctgtggccctgcagatggaatcagactttttaatgcattaaaaggccggatggtgcgtccaaggttaaccatttatgtttgtcaggaatcactgcagttgagggagcagcaacaacagcagcagcaacagcagcagaagcatgaggatggagactcaaatggtactttcttcgtttaccatgctatctatctagaagaactaacagctgttgaattgacagaaaaaattgctcagcttttcagcatttccccttgccagatcagccagatttacaagcaggggccaacaggaattcatgtgctcatcagtgatgagatgatacagaactttcaggaagaagcatgttttattctggacacaatgaaagcagaaaccaatgatagctatcatatcatactgaagtaggagtgcggcgtttcgtgcccagtggctgctccttccttcacctctgaaaacggccctcttgaagggggatatgaatggagatttgaaggtctgcaagaacctgactcgtctgactgtgtgtggaggagtccaggccatggaggcagaatcctggccctctgtgttggcccaagctcttgtggtacacacagattactgcccaatatgcagttctgcagctgttttagttaaatttctggaccttgttgttgttaaatatcagtagaaactctacataatttagagtgtatgtagggcataatgatgatgggaattgtgtgatgtttaacaggaagatcttaaattttgtgatatggagccctgtaatttttttcttatataaaaatgggtatctatattcataaaaaaaaaaaaaaaaaaaaaaa

SEQ ID NO: 51 - DNA, 1828 bp, Homo sapiens
acttctccctagagcaggggtgtttgccagcagcctgcactctcagaaatcagacttgagtggccggaacccttgagaccagaggcttaccatgctgctccctaggagggccaggaactgctgacgtgaccactggacagttattcgtgtctcttacaattaccaaacagaatggacaagcttaataaaataaccgtccccgccagtcagaagttgaggcagcttcaaaagatggtccatgatattaaaaacaatgaaggtggaataatgaataaaatcaaaaagctaaaagtcaaagcacctccaagtgttcctcgaagggactacgcttcagagagccctgctgacgaagaggagcagtggtccgatgactttgacagcgactatgaaaatccagatgagcactcggactcagagatgtacgtgatgcccgccgaggagaacgctgatgacagctacgagccgcctccagtagagcaggaaaccaggccggttcacccagccctgcccttcgccagaggcgagtatatagacaatcgatcaagccagaggcattccccacccttcagcaagacacttcccagtaagcccagctggccttcagagaaagcaaggctcacctccaccctgccggccctgactgctttgcagaaacctcaagtcccacccaaacccaaaggcctccttgaggatgaggctgattatgtggtccccgtggaagataatgatgaaaactatattcatcccacagaaagcagttcacctccacctgaaaaagctcccatggtgaatagatcaaccaagccaaattcctcaacgcccgcctctcctccaggaacagcttcaggtcgaaacagtggggcctgggaaaccaagtcacctccaccagctgcaccatccccgttgccacgggccgggaaaaaaccaacgacaccactgaagacaactccagttgcctctcaacagaatgcttcaagtgtttgtgaagaaaaacctatacctgctgaacgccaccgagggtcaagtcacagacaagaagctgtgcagtcaccagtgtttcctcctgcccagaaacaaatccaccaaaaacccatacctctgccaagatttacagaagggggaaacccaactgtggatgggcccctacccagcttttcatctaattccactatttcagaacaggaagctggcgttctctgcaagccatggtatgctggagcctgtgatcgaaagtctgctgaagaggcattgcacagatcaaacaaggatggatcatttcttattcggaaaagctctggccatgattccaaacaaccatatacactagttgtattctttaataagcgagtatataatattcctgtgcgatttattgaagcaacaaaacaatatgccttgggcagaaagaaaaatggtgaagagtactttggaagtgttgctgaaatcatcaggaatcatcaacatagtcctttggttcttattgacagtcagaataacacaaaagattccaccagactgaagtatgcagttaaagtttcataaagggggaaaaaaaagatcaataccattgcttcagacactttcccaaagtttctccttttgagaaaaagtcccaaaacttcatattttggattatgaatcatccagtaataaaatggaagatggagtcagctattgaagtggtcatccatttctttttaagaagctcatgtggacttgttctattgcctgacctgatgaactgttaatatctggtgaggttgagttatcatgctactaatattttccaaataaatatttttatttttaaaaataaaaaaaaaaaaaa

SEQ ID NO: 52 - DNA, 2397 bp, Homo sapiens
gcaagaactgaaacgaatggggattgaactgctttgcctgttctttctatttctaggaaggaatgatcacgtacaaggtggctgtgccctgggaggtgcagaaacctgtgaagactgcctgcttattggacctcagtgtgcctggtgtgctcaggagaattttactcatccatctggagttggcgaaaggtgtgataccccagcaaaccttttagctaaaggatgtcaattaaacttcatcgaaaaccctgtctcccaagtagaaatacttaaaaataagcctctcagtgtaggcagacagaaaaatagttctgacattgttcagattgcgcctcaaagcttgatccttaagttgagaccaggtggtgcgcagactctgcaggtgcatgtccgccagactgaggactacccggtggatttgtattacctcatggacctctccgcctccatggatgacgacctcaacacaataaaggagctgggctcccggctttccaaagagatgtctaaattaaccagcaactttagactgggcttcggatcttttgtggaaaaacctgtatcccctttcgtgaaaacaacaccagaagaaattgccaacccttgcagtagtattccatacttctgtttacctacatttggattcaagcacattttgccattgacaaatgatgctgaaagattcaatgaaattgtgaagaatcagaaaatttctgctaatattgacacacccgaaggtggatttgatgcaattatgcaagctgctgtgtgtaaggaaaaaattggctggcggaatgactccctccacctcctggtctttgtgagtgatgctgattctcattttggaatggacagcaaactagcaggcatcgtcattcctaatgacgggctctgtcacttggacagcaagaatgaatactccatgtcaactgtcttggaatatccaacaattggacaactcattgataaactggtacaaaacaacgtgttattgatcttcgctgtaacccaagaacaagttcatttatatgagaattacgcaaaacttattcctggagctacagtaggtctacttcagaaggactccggaaacattctccagctgatcatctcagcttatgaagaactgcggtctgaggtggaactggaagtattaggagacactgaaggactcaacttgtcatttacagccatctgtaacaacggtaccctcttccaacaccaaaagaaatgctctcacatgaaagtgggagacacagcttccttcagcgtgactgtgaatatcccacactgcgagagaagaagcaggcacattatcataaagcctgtggggctgggggatgccctggaattacttgtcagcccagaatgcaactgcgactgtcagaaagaagtggaagtgaacagctccaaatgtcaccacgggaacggctctttccagtgtggggtgtgtgcctgccaccctggccacatggggcctcgctgtgagtgtggcgaggacatgctgagcacagattcctgcaaggaggccccagatcatccctcctgcagcggaaggggtgactgctactgtgggcagtgtatctgccacttgtctccctatggaaacatttatgggccttattgccagtgtgacaatttctcctgcgtgagacacaaagggctgctctgcggaggtaacggcgactgtgactgtggtgaatgtgtgtgcaggagcggctggactggcgagtactgcaactgcaccaccagcacggactcctgcgtctctgaagatggagtgctctgcagcgggcgcggggactgtgtttgtggcaagtgtgtttgcacaaaccctggagcctcaggaccaacctgtgaacgatgtcctacctgtggtgacccctgtaactctaaacggagctgcattgagtgccacctgtcagcagctggccaagcccgagaagaatgtgtggacaagtgcaaactagctggtgcgaccatcagtgaagaagaagatttctcaaaggatggttctgtttcctgctctctgcaaggagaaaatgaatgtcttattacattcctaataactacagataatgaggggaaaaccatcattcacagcatcaatgaaaaagattgtccgaagcctccaaacattcccatgatcatgttaggggtttccctggctattcttctcatcggggttgtcctactgtgcatctggaagctactggtgtcatttcatgatcgtaaagaagttgccaaatttgaagcagaacgatcaaaagccaagtggcaaacgggaaccaatccactctacagaggatccacaagtacttttaaaaatgtaacttataaacacagggaaaaacaaaaggtagacctttccacagattgctagaactactttatgca

SEQ ID NO: 53 - DNA, 5891 bp, Homo sapiens
ccaggagagcggcgtggacgcgtgcgggcctagaggcccacgtgatccgcagggcggccgaggcaggaagctgtgagtgcgcggttgcggggtcgcattgtggctacggctttgcgtccccggcgggcagccccaggctggtccccgcctccgctctccccaccggcggggaaagcagctggtgtgggaggaaaggctccatcccccgccccctctctcccgctgttggctggcaggatcttttggcagtcctgtggcctcgctccccgcccggatcctcctgaccctgagattcgcgggtctcacgtcccgtgcacgccttgcttcggcctcagttaagcctttgtggactccaggtccctggtgagattagaaacgtttgcaaacatgtcccggatcgaaaagatgagcattctgggcgtgcggagttttggaatagaggacaaagataagcaaattatcactttcttcagcccccttacaattttggttggacccaatggggcgggaaagacgaccatcattgaatgtctaaaatatatttgtactggagatttccctcctggaaccaaaggaaatacatttgtacacgatcccaaggttgctcaagaaacagatgtgagagcccagattcgtctgcaatttcgtgatgtcaatggagaacttatagctgtgcaaagatctatggtgtgtactcagaaaagcaaaaagacagaatttaaaactctggaaggagtcattactagaacaaagcatggtgaaaaggtcagtctgagctctaagtgtgcagaaattgaccgagaaatgatcagttctcttggggtttccaaggctgtgctaaataatgtcattttctgtcatcaagaagattctaattggcctttaagtgaaggaaaggctttgaagcaaaagtttgatgagattttttcagcaacaagatacattaaagccttagaaacacttcggcaggtacgtcagacacaaggtcagaaagtaaaagaatatcaaatggaactaaaatatctgaagcaatataaggaaaaagcttgtgagattcgtgatcagattacaagtaaggaagcccagttaacatcttcaaaggaaattgtcaaatcctatgagaatgaacttgatccattgaagaatcgtctaaaagaaattgaacataatctctctaaaataatgaaacttgacaatgaaattaaagccttggatagccgaaagaagcaaatggagaaagataatagtgaactggaagagaaaatggaaaaggtttttcaagggactgatgagcaactaaatgacttatatcacaatcaccagagaacagtaagggagaaagaaaggaaattggtagactgtcatcgtgaactggaaaaactaaataaagaatctaggcttctcaatcaggaaaaatcagaactgcttgttgaacagggtcgtctacagctgcaagcagatcgccatcaagaacatatccgagctagagattcattaattcagtctttggcaacacagctagaattggatggctttgagcgtggaccattcagtgaaagacagattaaaaattttcacaaacttgtgagagagagacaagaaggggaagcaaaaactgccaaccaactgatgaatgactttgcagaaaaagagactctgaaacaaaaacagatagatgagataagagataagaaaactggactgggaagaataattgagttaaaatcagaaatcctaagtaagaagcagaatgagctgaaaaatgtgaagtatgaattacagcagttggaaggatcttcagacaggattcttgaactggaccaggagctcataaaagctgaacgtgagttaagcaaggctgagaaaaacagcaatgtagaaaccttaaaaatggaagtaataagtctccaaaatgaaaaagcagacttagacaggaccctgcgtaaacttgaccaggagatggagcagttaaaccatcatacaacaacacgtacccaaatggagatgctgaccaaagacaaagctgacaaagatgaacaaatcagaaaaataaaatctaggcacagtgatgaattaacctcactgttgggatattttcccaacaaaaaacagcttgaagactggctacatagtaaatcaaaagaaattaatcagaccagggacagacttgccaaattgaacaaggaactagcttcatctgagcagaataaaaatcatataaataatgaactaaaaagaaaggaagagcagttgtccagttacgaagacaagctgtttgatgtttgtggtagccaggattttgaaagtgatttagacaggcttaaagaggaaattgaaaaatcatcaaaacagcgagccatgctggctggagccacagcagtttactcccagttcattactcagctaacagacgaaaaccagtcatgttgccccgtttgtcagagagtttttcagacagaggctgagttacaagaagtcatcagtgatttgcagtctaaactgcgacttgctccagataaactcaagtcaacagaatcagagctaaaaaaaaaggaaaagcggcgtgatgaaatgctgggacttgtgcccatgaggcaaagcataattgatttgaaggagaaggaaataccagaattaagaaacaaactgcagaatgtcaatagagacatacagcgcctaaagaacgacatagaagaacaagaaacactcttgggtacaataatgcctgaagaagaaagtgccaaagtatgcctgacagatgttacaattatggagaggttccagatggaacttaaagatgttgaaagaaaaattgcacaacaagcagctaagctacaaggaatagacttagatcgaactgtccaacaagtcaaccaggagaaacaagagaaacagcacaagttagacacagtttctagtaagattgaattgaatcgtaagcttatacaggaccagcaggaacagattcaacatctaaaaagtacaacaaatgagctaaaatctgagaaacttcagatatccactaatttgcaacgtcgtcagcaactggaggagcagactgtggaattatccactgaagttcagtctttgtacagagagataaaggatgctaaagagcaggtaagccctttggaaacaacattggaaaagttccagcaagaaaaagaagaattaatcaacaaaaaaaatacaagcaacaaaatagcacaggataaactgaatgatattaaagagaaggttaaaaatattcatggctatatgaaagacattgagaattatattcaagatgggaaagacgactataagaagcaaaaagaaactgaacttaataaagtaatagctcaactaagtgaatgcgagaaacacaaagaaaagataaatgaagatatgagactcatgagacaagatattgatacacagaagatacaagaaaggtggctacaagataaccttactttaagaaaaagaaatgaggaactaaaagaagttgaagaagaaagaaaacaacatttgaaggaaatgggtcaaatgcaggttttgcaaatgaaaagtgaacatcagaagttggaagagaacatagacaatataaaaagaaatcataatttggcattagggcgacagaaaggttatgaagaagaaattattcattttaagaaagaacttcgagaaccacaatttcgggatgctgaggaaaagtatagagaaatgatgattgttatgaggacaacagaacttgtgaacaaggatctggatatttattataagactcttgaccaagcaataatgaaatttcacagtatgaaaatggaagaaatcaataaaattatacgtgacctgtggcgaagtacctatcgtggacaagatattgaatacatagaaatacggtctgatgccgatgaaaatgtatcagcttctgataaaaggcggaattataactaccgagtggtgatgctgaagggagacacagccttggatatgcgaggacgatgcagtgctggacaaaaggtattagcctcactcatcattcgcctggccctggctgaaacgttctgcctcaactgtggcatcattgccttggatgagccaacaacaaatcttgaccgagaaaacattgaatctcttgcacatgctctggttgagataataaaaagtcgctcacagcagcgtaacttccagcttctggtaatcactcatgatgaagattttgtggagcttttaggacgttctgaatatgtggagaaattctacaggattaaaaagaacatcgatcagtgctcagagattgtgaaatgcagtgttagctccctgggattcaatgttcattaaaaatatccaagatttaaatgccatagaaatgtaggtcctcagaaagtgtataataagaaacttatttctcatatcaacttagtcaataagaaaatatattctttcaaaggaacattgtgtctaggattttggatgttgagaggttctaaaatcatgaaacttgtttcactgaaaattggacagattgcctgtttctgatttgctgctcttcatcccattccaggcagcctctgtcaggccttcagggttcagcagtacagccgagactcgactctgtgcctccctccccagtgcaaatgcatgcttcttctcaaagcactgttgagaaggagataattactgccttgaaaatttatggttttggtatttttttaaatcatagttaaatgttacctctgaatttacttccttgcatgtggtttgaaaaactgagtattaatatctgaggatgaccagaaatggtgagatgtatgtttggctctgcttttaactttataaatccagtgacctctctctctgggacttggtttccccaactaaaatttgaagtagttgaatggggtctcaaagtttgacaggaaccttaagtaatcatctaagtcagtacccaccaccttcttctcctacatatcccttccagatggtcatccagactcagagctctctctacagagaggaaattctccactgtgcacacccacctttggaaagctctgaccacttgaggcctgatctgcccatcgtgaagaagcctgtaacactcctctgcgtctatcctgtgtagcatactggcttcaccatcaatcctgattcctctctaagtgggcattgccatgtggaaggcaagccaggctcactcacagagtcaaggcctgctccctgtagggtccaaccagacctggaagaacaggcctctccatttgctcttcagatgccacttctaagaaaagcctaatcacagtttttcctggaattgccagctgacatcttgaatccttccattccacacagaatgcaaccaagtcacacgcttttgaattatgctttgtagagttttgtcattcagagtcagccaggaccataccgggtcttgattcagtcacatggcatggttttgtgccatctgtagctataatgagcatgtttgcctagacagcttttctcaactgggtccagaagagaattaagccctaaggtcctaaggcatctatctgtgctaggttaaatggttggcccccaaagatagacaggtcctgatttctagaacccgtgactgttactttatacagcaaaggaaactttgcagatgtgattaaagctaaggaccttaagacagagtatcctgggggtggtggtggggtgggggggggtcctaaatgtaatcacgagtaagattaagagcaaatcaattctagtcatatattaaacatccacaataaccaagatatttttatcccaagaatgcaagatttcagaaaatgaaaaatctgttgataaatccatcactataataaaaccgaaggtgaaaaaaattctgaaaaaaaaaaaaaaaaaaaaaaaaaaaa

SEQ ID NO: 54 - DNA, 1900 bp, Homo sapiens
gcggccgcggaggaggaggaaggggaggagggcgaggcgggaggtgcaggagggaccctcgccatgggtccacgggcctagagtggcggaagataccggcctggtgccaaactggctactgctgcttcctgtggcctccatggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagcgtgtgggctgtggggagtgtgcagcctgccaggtaacagaagactgtggggcctgctccacctgcctcctgcagctgccccatgatgtggcatcggggctgttctgcaagtgtgaacggagacgctgcctccggattgtggaaaggagccgagggtgtggagtatgccggggctgtcagacccaagaggattgtggccattgccccatctgccttcgccctccccgccctggtctcaggcgccagtggaaatgtgtccagcgacgttgcctacggggtaaacatgcccgccgcaagggaggctgtgactccaagatggctgccaggcggcgccccggagcccagccactgcctccaccacccccatcacagtccccagagcccacagagccgcagccctacacgaaccgccggcagaaccgcaagtgcggggcctgtgcagcctgcctacggcggatggactgtggccgctgcgacttctgctgcgacaagcccaaattcgggggcagcaaccagaagcgccagaagtgtcgttggcgccaatgcctgcagtttgccatgaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaagtctgcagggcaggcactcgggaagggaagatggatgtaaagtgtgggagaccgaggacacagtggagcccacgagcacgagctggaacccacgaggatggcctggaacccatgtcagtctctcaccacctccagcttcgatgatgtgggtgtcctgcagaagaagctggtgcccttcctcacagagttaa

SEQ ID NO: 55 - DNA, 3803 bp, Homo sapiens
ggctcccgacacccgagccccgccgcgcctcccgctcccggctcccggctcccgctcctggctccctccgcctcccccgcccctcgccccgccgccgaagaggcccgctcccggtcggacgcctgggtctgccgggaagagcgatgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcgttgctgctctccaatccagcctaccgcctccttctggccacttacgcccgtccccctcgaggcccgggcccccccacacccgcctgggccaaacccaccaacacccaggcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcaagggagctgatgccccttctccccttcctggacacactctcatgtccccttcctgttcttccttcctagaagcccctgtcgcccacccagctggtcctgtggatgggatcctctccaccctcctctagccatcccttggggaagggtggggaaaaatataggatagacactggacatggccaattggagaacctgggccccactggacaacactgattcctggagaggagaccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagactctctaagcctatacgtttctgtggagtaaatattgggattggggggaaatagggtgcaacgcccatagccttggggttggacatctctagtgtagctgccacattgatttttctataatcacttggggtttgtacatttttggggggagagacacagattttacactaatatatggacctagcttgaggcaattttaatccctgcactaggcaggtaataataaatgttgagttttccaaaaaaaaaaaaaaaaaaaaaaaaaaaaa

SEQ ID NO: 56 - DNA, 1668 bp, Homo sapiens
gagaagccgggagcgagcccaggcggcagtcttgattcccttttggccagcagtgtttaggtctgtcagtactgcactgcaagaatggcagattttgggatctctgctggccagtttgtggcagtggtctgggataagtcatccccagtggaggctctgaaaggtctggtggataagcttcaagcgttaaccggcaatgagggccgcgtgtctgtggaaaacatcaagcagctgttgcaatctgcccacaaagaatccagctttgacattattttgtcaggtttagtcccaggaagcaccactctgcacagtgctgagattttggctgaaatcgcccggatccttcggcctggtggatgtctttttctgaaggagccagtagagacagctgtagataacaatagcaaagtgaagacagcatctaagctgtgttcagccctgactctttctggtcttgtggaagtgaaagagctgcagcgggagcccctaacccctgaggaagtacagtctgttcgagaacaccttggtcatgaaagtgacaacctgctgtttgttcagatcacaggcaaaaaaccaaactttgaagtgggttcttctaggcagcttaagctttccatcaccaagaagtcttctccttcagtgaaacctgctgtggaccctgctgctgccaagctgtggaccctctcagccaacgatatggaggacgacagcatggatctcattgactcagatgagctgctggatccagaagatttgaagaagccagatccagcttccctgcgggctgcttcttgtggggaagggaaaaagaggaaggcctgtaagaactgcacctgtggccttgccgaagaactggaaaaagagaagtcaagggaacagatgagctcccaacccaagtcagcttgtggaaactgctacctgggcgatgccttccgctgtgccagctgcccctaccttgggatgccagccttcaaacctggggaaaaggtgcttctgagtgatagcaatcttcatgatgcctaggaggttcctgacatgggacccatctgctcctccagccaactcctgtccctcacatcccaccatggtggctcctcccacctcctctggatttgttcactctgagatctgtttgcagagtgggtgcttagcagacagagtgaagctggctggggggcacagtggtgtgtagtgctgctgtgtatcaaaagaccaaggtattatgggacctggtttcagaatgggatgggtttcttcacctcatgttaagagaagggagtgtgtcctgaagaagcccttcttctgatgttaaaatgctgaccagaacgctcttgagcccaggcatcgttgagcattaacactctgtgacagagctgcagacccctgccttgagtctcatctcagcaatgctgccaccctcttgtctttcagagttgttagtttactccattctttgtgacacgagtcaagtggctcacaacctcctcagggcaccagaggactcactcactggttgctgtgatgatatccagtgtccctctgcccccttccatccccaaccacatttgactgtagcattgcatctgtgtcctgttgtcatttatgttaaccttcaggtattaaacttgctgcatatcttgaaaaaaaaaaaaaaaaaaaaaaaaaaaa

SEQ ID NO: 57 - DNA, 1044 bp, Homo sapiens
cacgagggcgtccctctgcctgcccactcagtggcaacacccgggagctgttttgtcctttgtggagcctcagcagttccctctttcagaactcactgccaagagccctgaacaggagccaccatgcagtgcttcagcttcattaagaccatgatgatcctcttcaatttgctcatctttctgtgtggtgcagccctgttggcagtgggcatctgggtgtcaatcgatggggcatcctttctgaagatcttcgggccactgtcgtccagtgccatgcagtttgtcaacgtgggctacttcctcatcgcagccggcgttgtggtctttgctcttggtttcctgggctgctatggtgctaagactgagagcaagtgtgccctcgtgacgttcttcttcatcctcctcctcatcttcattgctgaggttgcagctgctgtggtcgccttggtgtacaccacaatggctgagcacttcctgacgttgctggtagtgcctgccatcaagaaagattatggttcccaggaagacttcactcaagtgtggaacaccaccatgaaagggctcaagtgctgtggcttcaccaactatacggattttgaggactcaccctacttcaaagagaacagtgcctttcccccattctgttgcaatgacaacgtcaccaacacagccaatgaaacctgcaccaagcaaaaggctcacgaccaaaaagtagagggttgcttcaatcagcttttgtatgacatccgaactaatgcagtcaccgtgggtggtgtggcagctggaattgggggcctcgagctggctgccatgattgtttccatgtatctgtactgcaatctacaataagtccacttctgcctctgccactactgctgccacatgggaaactgtgaagaggcaccctgggcaagcagcagtgattgggggaggggacaggatctaacaatgtcacttgggccagaatggacctggcctttctgctcccagacttgggggctagattagggaccactccttttaggcgatgcctgactttgcctt

SEQ ID NO: 58 - DNA, 1764 bp, Homo sapiens
gggaaactgtgtaaagggtggggaaacttgaaagttggatgctgcagacccggcatgggtagcaagaaactaaaacgagtgggtttatcacaagagctgtgtgaccgtctgagtagacatcagatccttacctgtcaggactttttatgtctttccccactggagcttatgaaggtgactggtctgagttatcgaggtgtccatgaacttctatgtatggtcagcagggcctgtgccccaaagatgcaaacggcttatgggataaaagcacaaaggtctgctgatttctcaccagcattcttatctactaccctttctgctttggacgaagccctgcatggtggtgtggcttgtggatccctcacagagattacaggtccaccaggttgtggaaaaactcagttttgtataatgatgagcattttggctacattacccaccaacatgggaggattagaaggagctgtggtgtacattgacacagagtctgcatttagtgctgaaagactggttgaaatagcagaatcccgttttcccagatattttaacactgaagaaaagttacttttgacaagtagtaaagttcatctttatcgggaactcacctgtgatgaagttctacaaaggattgaatctttggaagaagaaattatctcaaaaggaattaaacttgtgattcttgactctgttgcttctgtggtcagaaaggagtttgatgcacaacttcaaggcaatctcaaagaaagaaacaagttcttggcaagagaggcatcctccttgaagtatttggctgaggagttttcaatcccagttatcttgacgaatcagattacaacccatctgagtggagccctggcttctcaggcagacctggtgtctccagctgatgatttgtccctgtctgaaggcacttctggatccagctgtgtgatagccgcactaggaaatacctggagtcacagtgtgaatacccggctgatcctccagtaccttgattcagagagaagacagattcttattgccaagtcccctctggctcccttcacctcatttgtctacaccatcaaggaggaaggcctggttcttcaagcctatggaaattcctagagacagataaatgtgcaaacctgttcatcttgccaagaaaaatccgcttttttgccacagaaacaaaatattgggaaagagtcttgtggtgaaacacccatcgttctttgctaaaacatttggttgctactgtgtagactcagcttaagtcatggaattctagaggatgtatctcacaagtaggatcaagaacaagcccaacagtaatctgcatcataagctgatttgataccatggcactgacaatgggcactgatttgataccatggcactgacatgggcacacagggaacaggaaatgggaatgagagcaagggttgggttgtgttcgtggaacacataggttttttttttttaactttctctttctaaaatatttcattttgatggaggtgaaatttatataagatgaaattaaccattttaaagtaaacaattccgtggcaactagatatcatgatgtgcaaccagcatctctgtctagttccaaatattttcatcaccccaaaagcaagacccataaccattatgcaagtgttcctatttccccctcctcccagctcctggaaacccaccaatctactttgttgctatggctttacctattctggatatttcatataaatggaatcatatagtgtcataaaaaaaaaaaaa

SEQ ID NO: 59 - DNA, 3738 bp, Homo sapiens
cccgggtcggaccgcctgggtctgccgggaagagcgatgagaggtgtcgtaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgtcgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgagtgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagtgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcgttgctgctctccaatccagcctaccgcctccttctggccacttacgcccgtccccctcgaggcccgggcccccccacacccgcctgggccaaacccaccaacacccaggcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccgtgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgccccttcccctcccgacagcccatcacctctaatagaggcagtgagactgcaggctgggcccacccagggagctgatgccccttctccccttcctggacacactctcatgtccccttcctgttcttccttcctagaagcccctgtcgcccacccagctggtcctgtggatgggatcctctccacccacctctagccatcccttggggaagggtggggagaaatataggatagacactggacatggcccattggagcacctgggccccactggacaacactgattcctggacaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcaccccccacttcccacctgcagtcttgtagctagaacttctctaagcctatacgtttctgtggagtaaatattgggattggggggaaagagggagcaacggcccatagccttggggttggacatctctagtgtagctgccacattgatttttctataatcacttgggtttgtacatttttggggggagagacacagatttttacactaatatatggacctagcttgaggcaattttaatcccctgcactaggcaggtaataataaaggttgagttttccac

SEQ ID NO: 60 - DNA, 1302 bp, Homo sapiens
ggaagctatgagggaccctgtgagtagccagtacagttcctttcttttctggaggatgcccatcccagaactggatctgtcggagctggaaggcctgggtctgtcagatacagccacctacaaggtcaaagacagcagcgttggcaaaatgatcgggcaagcaactgcagcagaccaggagaaaaaccctgaaggtgatggcctccttgagtacagcaccttcaacttctggagagctcccattgccagcatccactccttcgaactggacttgctctaaggccaagacttctctctcccatcaccttgccctcattgtcttccctctcaagccccttcctttccactcctttcccattttaatcttgttctctccctactgtgttggtggtgctgatgaatctgccagagttgagttctatgtatttatttatctatctgtctactccatttctctcaaaagccctcaagtcacaaagtaaatggttcaagcaatggagtactgggtcacagggattcctcctttcccccccaaatattaactccagaaactaggcctgactggggacacctgagagtagtatagtagtgcaaaatggaagactgatttttgactctattataatcagcttcagagattccttaaaccttcctaatttcctgctccagggcagtaaacacaaatatttcttcaaggggtgatgaaaacctcggaagttttaatttgaggttatctgctacgaaacagtatttctaaaaggctaaagtgataagtctcttgcttttttttgatcctgctcttatattcttttttttcctcagagaaatcaggagggtagttagaggtataaaacaggaggaaatattatggaaaatgaaaatagggaaaataattgaatcattttagaagtagctaatttcttttctcaaaagagtgtcccttcttcacacctactcactttacaactttgctcctaactgtgggttgaaaactctagctaaagaaagttatcaaatcttaacatgcattcctactattatgatagtttttaaggtttcaattcaatcttctgaacggcataagtcctattttagccttacctcctgcatttgcaatacgtaatactgatcagtgggcacagttcttcagctacattgagaccctgaaatgaacaattatattctgactcgacatcttgtccccaatccttccaaaaatattgatggtgatttgtgctaccatttactcgtttatttaataaagacattcaatcccaggaaaaaaaaaaaaaaaaaaaaaaa

SEQ ID NO: 61 - DNA, 1471 bp, Homo sapiens
aaactttttccccggcgtggtctcactcgcgatttaaggcataggtgtcgccgagccgggaggctgggagtcgccaggcgtgcgggggagaggcctgggccgcgccgcggcggggggtggaggaagagggcaggcgaggcgggaaggtgggctctggccgccgggagccggggacggagccgccgccgttgcccctagcggggagcagccgggaggagggggccgcagtcgggagaggggaccccaccatgcccaaagtcttcctggtgaagaggaggagcctgggggtctcggtccgcagctgggatgagctcccggatgagaaaagggcagacacctacatcccagtgggcctaggccgcctgctccacgacccccccgaggactgccgcagcgacggcggcagcagcagcggcagcggcagcagcagcgcgggggagcctggaggagcagagagcagctcgtccccgcacgcccccgagagcgaaacccccgagcccggcgacgccgagggccccgatggacacctggcgaccaagcagcgcccggtcgccagatcgaaaatcaagttcaccacaggcacgtgcagcgactcggtggttcacagctgtgacctgtgtggcaagggcttccgtctgcagcgcatgctgaaccgtcacctcaagtgccacaaccaggtgaaaagacacctgtgcaccttctgcggcaagggcttcaacgacaccttcgacctgaagaggcacgtccgcacacacacaggcattcgtccctacaaatgcaacgtctgcaataaagccttcacccagcgctgctctctggagtcccacctgaagaaaatccatggggtgcagcagcagtatgcctataagcagcggcgggacaagctctacgtctgcgaggattgcggctacacgggccccacccaggaggacctgtacctgcacgtgaacagtgcccatccgggcagctcgtttctcaaaaagacatctaaaaaactggcagcccttctgcagggcaagctgacatccgcacaccaggagaataccagcctgagtgaggaggaggagaggaagtgaggagaaggaaggggaggacagacgttcacactgccacgtatgtctacgtggatttttggttttcagcttcccccaccccactggctcttcttaattagaagtgaccagttcacctctgtgtccttttgaaacatcagcagtagggtccattccaagattgtcagttaccgttagtgacgtcaggccctgtaacctgtgtcctgtctggcgcagttgctcacattcaccaaagtttgttttcatgatcctgatggccaagaacaccgtgtgggattttttttcccccaaggattttcacacacggaaggagaggtatttcttagagagatcatcattttatggtgccttgaaataaaaatacttctacttgaaatgctaaaaaaaaaaaaaaaaaa

SEQ ID NO: 62 - DNA, 1062 bp, Homo sapiens
atgggtatctttcccggaataatcctaatttttctaagggtgaagtttgcaacggcggccgtgattcaccagaaaagtaccactgtaagtcatgagatgtctggtctgaattggaaaccctttgtatatggcggccttgcctctatcgtggctgagtttgggactttccctgtggaccttaccaaaacacgacttcaggttcaaggccaaagcattgatgcccgtttcaaagagataaaatatagagggatgttccatgcgctgtttcgcatctgtaaagaggaaggtgtattggctctctattcaggaattgctcctgcgttgctaagacaagcatcatatggcaccattaaaattgggatttaccaaagcttgaagcgcttattcgtagaacgtttagaagatgaaactcttttaattaatatgatctgtggggtagtgtcaggagtgatatcttccactatagccaatcccaccgatgttctaaagattcgaatgcaggctcaaggaagcttgttccaagggagcatgattggaagctttatcgatatataccaacaagaaggcaccaggggtctgtggaggtgcttatgttcaaaagctgttaccggctgtgtgctgtggctcatgcctgtaatcccagcactttgggaggccaacgcgggtggatcacttgagggtgtggttccaactgctcagcgtgctgccatcgttgtaggagtagagctaccagtctatgatattactaagaagcatttaatattgtcaggaatgatgggcgatacaattttaactcacttcgtttccagctttacatgtggtttggctggggctctggcctccaacccggttgatgtggttcgaactcgcatgatgaaccagagggcaatcgtgggacatgtggatctctataagggcactgttgatggtattttaaagatgtggaaacatgagggcttttttgcactctataaaggattttggccaaactggcttcggcttggaccctggaacatcattttttttattacatacgagcagctaaagaggcttcaaatctaa

SEQ ID NO: 63 - DNA, 979 bp, Homo sapiens
aaaatataagccagggtattactggccacctgactctacagcgtcccacatgcgaacacaggctagacaagggaggagtttctcaaacggttttaatcggttctctccgcgtcacaagccatcgggtaaggcaacggaatgtgcgtggggtcccctgtggctccgcggtcacaatactgagcctggaattgctgttagcaaaatatacatttgtgtcaccataaaaaaccgcgccgccggccctcgggtctcacaacaggtataaaacaattataaatatttacacccttgttacacgcttttacggaaaggggatccgtaggagagcccccgggacaggacgcgggggcggtagaaagagcacagagaagacaggaggagcgcccgccttccgggtcccagcatcagaggcaggcaaaacacagaaatgagactttggtccaaaatttgaaggaagaaaaaaccctgaagtttgagagcaaggttgttctatggcgactgcacggtgaaggcgtaggtgtaaggcaaccggaggcgatgccagaggcggcgacaacggcccgccccttccctgaagctcaggggctctaagataggaccggggctccctgtgcctgacccactgggcggcccgacctgctctctggaaactgggtcctgcctgtgacttaattacgaagggaaaataccaatgagcgagtaagcaggcatagcagggataactacccacaagggagagtataagattacattcataccattgtatctgtctggctatgcaagagttcgttgagaagctagttctttttgcctattacttggaaccgcactgacacttttgctcaacggagacatgcggaaggccgaacgtagaatgcagttttaccagcgatgatgcaccgtccagtgcagaagggaacgctgggaaaggacgctggccggtgcagacaacaagtaaagcggttggttaacgccacag

SEQ ID NO: 64 - DNA, 715 bp, Homo sapiens
tctcgctggtgtgaccccctcaccccttggatcgccaggacaccccggggtggtggggtggctgcaggaagggaggttttttaaggcacaaggaagccaagtcgtggtcggggcgcccagctgcaggccccacgcccgacacaggccccaccaaggcatgggcccgagggtctggccccgggtgtggagggccgggaactcccgctgccacagtcaccaagagcctgagctgtccctgtcaccgcaggtgaggcaaggtgaactagatttaattttttttaaaaacaggtaaactgatttctctttaaaaaaataaaatctctggtctgctaaggtcacttcagctgtttttaaagatggctttctctggaatgatggaagttgtcgccaggggcccggcgtgtgggcctgtgactcagatggtggatctggagaaggagacccgagtgagtggttctccccaggttctggttgtgcaggtcaatgaaggcctggaccgcctccttcacgagcccatgtggatgagtggcaatcttgcagtcctttctggagaacttgaattctttgaagtacggcccaatatgtggaaaataagaacttgagattctttcttcgagacttaggggcgggattgttggagaagtggagtcttggcacagggcggaaatattttatcggaaattactcggagacccgacttcttggaagcggtgca

SEQ ID NO: 65 - DNA, 918 bp, Homo sapiens
ttctaatctttctctggggggaacaggccacagaactgtgttagaggtgaaccatcttaattactagttctattacctaattcagcttccttgtttggtctgctgtggatctgccttattgcatacgccatgcatcagataatggatgcatcagataatggtgttagacaaagcttcattgtgaacaacctaatgcattttagagaaacaatctcatcacattttttctagcctttcctacatttaaacttgctgttgcccaaattataattttttaaatgtctttggtgggcttctgttaattcacatgacttgagcttatagctatgtctactgcacagattgggtaatggaacactaaacttttatacttgaaaatgacagccttaaatgctcatatcagtcacaaatctaggatgtactgtcttgttgtatgtgagctttgtagagatttttaaaaatataagcatcaccttcccattgaagagtggagagagtctactggatgactggccaggaactttctctctgaatcggacatttggatgtcttctttcttccaagaaatggtggttcacattaaagtatcatggcttatgtatgctcaaatggaatcttatgttactttcttattaaatctggtctgcctattttagataacatgcacggcatgtcttcaccaatcacatatagctgagatgcacacatggataacgacatccacggtcatttcaaattccactgccttggggatctaagatatcggggggcaggcccaacattccgacctcactgtctaatcagtgagcaatgctccaaaacattgatgcccacggcacctccccgtgtcccaacgaacaaccccacaattccaacgcggccccccgattctccaccgctctgctcacttactaatag

SEQ ID NO: 66 - DNA, 1139 bp, Homo sapiens
ttttvttgtggactgagtttttttttttcctttacatcaaatatcctcaatggaagaggggatattgcacacaaatatcataaaagcactacatattactttcactggaaactaattttctacattagatatgactggataggatagaagtgatgcaggattataagacataataccatacacagctgcagactgaaacaaacaccattcagaacaagaaaaaggagtttaaagtgcttttcagckgggctcaagaccacttctttccagtcctggaaagaggggctgcatgcagtttaggaaaagcgtgtttttgaactgccacagggtgtcctcgaaagggcagcccggtcttgatgccactcctccatggctcctgttttggggagcyccaaacaagtccagaaaagctgcctattttttcccttccttttcagtttttgatgctgcctttaaaaatcaacttcatgaagtcacagattttttaacagtaaatagttttaataccaggtgaataacctaattgctttcaaagaaatgctcatccctaggctgcttttggtgtattgttcagttggttaaaagataaaagcttacagtccctttcaaatggaaacaggatcttttcttctaaatctgaagcacaaaaaaaaaaagttattatcctaactcacaatatcattactgagcaggaacctcctgtaamaggtgahtaaagaraggaaagaaaagcaaattcagaattgtagagcagcycctaagagctgaaatttggtaacagagggaaaatgaaaggkggtaagatttccattagcaaatgattaaatcttaattaaatgagttttggaaagctcctagactgcataagctattggagaaactwaaaacatttatatacactggggaaccatttactatkawatgtaacgttaagaaaaaaaatttttttgaactcatgggaaatggtgtttaaagagggggagggggggaagttagttattgtwtccagtcccccacaagacttaaaaagcatgccagggctcagggttttgagaaggggaaagattggttaaaattgaaatggaggatmacgctaaattwakytytttgattttgttwagatacacmaaaaggtatga

SEQ ID NO: 67 - DNA, 574 bp, Homo sapiens
ttttttaagatttaatgctttattgctcttgatggcaaatcaaaatatgctttagaaataaagttaatttactggaaaataggagtttttgcaccaaaccataaaattgcatttcattacatcaagagaaccccctcattgtctacaatcatgcccgcttcctttcccctcagcgcccgggacacgtgaccgagatcataccctaaattcctgatccttttgcagttgccacatactgtggcttttagtacatcataaaaaagtgctttcctgtggcctcagctgggaggccctggcgctggggctaaggggcccaaggcaccatccaaaggctgggaggaaagaacccaaacccaggccctcctcctgccctcaagcctttgacaggcaactcatttggcatgatctgttttggtgtgtttaaaacatacatttgcatgtgtctagtgtaaagcaacaagtttgaggaaataagtggaaggagagaggaagttccagttagatggttccactagtgtctactggtaattggcaaaactatgagtgttgctaacctgggctgagggcacctctg

SEQ ID NO: 68 - DNA, 524 bp, Homo sapiens
ctctgccagaaaaaacgtttaattccctcatgaccaaaacaaaaaagaactggcttcaacaactagctgggtctgtgctggcctccaagaccttgaatagcccaaatatggagaggttaggtaatgtggccatagtgggcgtgggatgagacatcatcagttcacgccaacacccgtggctttcctcagcagcccaggtttctccatttccccctctgggctctgaatttgtcctcctgtcccagactcatagcctcccctaaagggcagaaggtaccagtgaggctgaggctgaaggaacacccaaagactccaagatcggaggggagggcccactccctggagcctactgaccccctccagctggactgacagcctgccagggacaaagcaggaccctgaccacaggaccctcgggaatagcccctctactcttgctccccagggaactcccctggaagagggaccctcagcatttctgggagtccaggggcctgctgcccacaatccccaggtagcctcag

SEQ ID NO: 69 - DNA, 819 bp, Homo sapiens
tagttgatcagtccgtaatcaagaaaaaaaagtataaactttaataatgctgtgaacgtggtttccatatttattttctctgatgggtgactgcacatcagtcatcttgagtttatgctaactacttaggctggtcacgacacacacacacatacagagaagtcacacaggctgtaccgggctggctgttgcaaatgtacatgaattacacgggttgaagttgtttggcagctagttaacatatgccacccaatgacgggacacaatctggtcacacgctgcctctcctgcctgttgctgttctttacaaaggtccgtgtgtcgggctggcaaagtggcatcctgctggcatctctgtggtggccccggaatggtggagtgcccaggtcagcatctactctgggtcccattctcaactgctctggccttgacatcagagcttccggttccctgctggctcttctgcacactggatccatgccagtccaggccccctccaggcacacacctgaggcagactgagagcacaatggacgctgtcctgatgtgaactgtgcccagacacaggatggggggaagcgggagatgtgaccacaacaaccacacacaagctccgatctttacagatgggccctctgggactgctatatggggtggtgcccgagagacacgggggccatgtggagcccaccaggcacagttgctgggaagaggacagacaggaggggacctgtgcccagtgcctgacctgaaagcaaagccaaaaagggtgaaggggaacgtgttcgaacaggtgcctaatgttgaaaagtcagacta

SEQ ID NO: 70 - DNA, 572 bp, Homo sapiens
  misc_feature (1)..(572): n = a,c,t, or g
caggcttgttgatgcattttattgtgagatgggagtctggtaaaaaactagaaaatgaccatgatgtaacaaggaacttaaaaatgaagagtcagatctgtaacttacatacatgaatacaggaacaaattggcacaaaatgttaaacattgttcccaacactgtttatagaagttaatcctaatttggcttactaaggaaatgagagttgtatggttaggctgatttctttaataaaactgcagagcatcatgctattagtcacacagtgaatttcaaaatttaagttttatattaaaaactgggtaaaggtaaaatgacttgattgtagttgtaaaactaatacattcccatttaagttctgttctacagtccaaggcaagtataaatgttaacataacactgttaaatcaaatctcaatgcaggagaaccaattgcatctctactttaaatcttatcaactttccaaattttcatactaaaatatattattgtattaatacaaactacagtattatacactacactgtgtaataaataaagaaatatanaaataagacacataaatata

SEQ ID NO: 71 - DNA, 642 bp, Homo sapiens
  misc_feature (1)..(642): n = a,c,t, or g
gggtttttttgaagcttttataaatgaggttaaacaaatgccaaattacggtgtgttagtacaagtctgtagcatctgtgtacagcaacatccatccaaaggcagaatcacagcctcgtatcggcctcgagtcttgagtcacattcatatcttaaaatacacgagtattccttttccgtctagtctcagttataggcagctacttcccagactctactttcacttctctctactttttcagacctggttcccatggcactagtgtagaaggttttagggtataagaagagggggcaataaggctaccctatcactatgacaaccaagaaggaggctggagcgtgaatccccaacgctgagggtggggagccatccctctctaccaaggtggcaatgatggagggaacttgcatggctaagcatccaggatgccatgcagcagacaccagggagcactgagccactgctggagcatttcctgcctctgccaggcggcctgcggaaagtgtttcacataactaaaaaaagtcaacacagtctcatgtatgcattaaaaaaaagctgtcnagtataaaaanccagacactggaagctgaaagacaagtgagtgtgagagccntctccaggcacacagtngagtgc

SEQ ID NO: 72 - DNA, 543 bp, Homo sapiens
  misc_feature (1)..(543): n = a,c,t, or g
catatgtacannnttcnntattaaaagtatggcactttatataacagcagaaataattacatgatttcacatccagaagcaataaaatgtggaggtgcaaacattccttattcccaataaaagtaaaaaagtttcaacatgttctgtaagcccttaattgcataaagtatatttagcatcatttacagccagtacacttatataaactaattatcattaccttttacattctgcaaaagaaatatgttaaagtaaagaagcatggcgagacaaacatgaattaaatgtcagttctgatcattcatggggaaatataagccgataattataaactactagataacacaatgattttaacaatttttgatgtttttaaagttaaaaaaactccactacatgccatattgaaagaaaaggttgttttttttttaactgcagcacctttagacaacaaaagattgcatcctgttcaaccacactatataaattataacatttgtggaaaatatgtacacacaaacataaagcaagtgttctaacagt

SEQ ID NO: 73 - DNA, 607 bp, Homo sapiens
  misc_feature (1)..(607): n = a,c,t, or g
ccaaacaagattatactcactcaaggcaagtgcaagatcttgaagtactagcagttaagtaatattgaattgtattgaatagttcacatagtntattctagtctttgaaaattactgaacatggacaatgtgcatgtcattgacatctgccttagaacttctgggacaatcctgattcgagagattctatcccattatttacatataccaaaaatactttgttaatttaatgtgttggcttcccaactcctgaacacgacacaattttattattagattttgtatggtgattttaggctatgaaaacatgatcattatatgtatatagatacatttttatttgttacaaatgtttgagcagctcactagcccacccctcctctattttgggtaagagaatttactaccttttttaactatgtagttgagagcaacatgtattttgttatttttagaatggtcagtatattgctataaaattttaaatgagcctatgaaagttaaagtattctgattctggttaaattaacgaatatggttccaggccctgttctctgggtttttgagagagaataaaggttatgtttgtcttaaaaaaaaaaaaaaa

SEQ ID NO: 74 - DNA, 1198 bp, Homo sapiens
ccggcaaagcccagctacaggcgggcgactgcggggggcccctgaggcggcgggggccatggctggggtcgcgtgcttgggaaaagctgccgacgcagatgaatggtgcgacagcggcctgggctccctgggtccggacgcagcggcccccggaggacctgggttgggcgcggagttgggcccggggctgtcgtgggctcccctcgtcttcggctacgtcactgaggatggggacacggcactgcacttggctgtgattcatcagcatgaacccttcctggattttcttctaggcttctcggccggcactgagtacatggacctgcagaatgacctaggccagacagccctgcacctggcagccatcctgggggagacatccacggtggagaagctgtacgcagcaggcgccgggctgtgtgtggcggagcgtaggggccacacggcgctgcacctggcctgccgtgtgggggcacacgcctgtgcccgtgccctgcttcagccccgcccccggcgccccagggaagcccccgacacctacctcgctcagggccctgaccgtactcccgacaccaaccatacccctgtcgccttgtaccccgattccgacttggagaaggaagaagaggagagtgaggaggactggaagctgcagctggaggctgaaaactacgagggccacaccccactccacgtggccgttatccacaaagatgtggagatggtccggctgctccgagatgctggagctgaccttgacaaaccggagcccacgtgcggccggagcccccttcatttggcagtggaggcccaggcagccgatgtgctggagcttctcctgagggcaggcgcgaaccctgctgcccgcatgtacggtggccgcaccccactcggcagtgccatgctccggcccaaccccatcctcgcccgcctcctccgtgcacacggagcccctgagcccgagggcgaggacgagaaatccggcccctgcagcagcagtagcgacagcgacagcggagacgagggcgatgaatacgacgacattgtggttcacagcagccgcagccaaacccggctgcctcccaccccagcctcaaaacctcttcctgacgacccccgccccgtgtgatttgtttcattgttaatataatttccagtttaataaacaaaaccctagttctgacaaccagaaaaaaaa

SEQ ID NO: 75 - DNA, 976 bp, Homo sapiens
  misc_feature (1)..(976): n = a,c,t, or g
cttcaatttgaaatcaccttttctaaaaagtcaattcatctagttaagtcgctgaacaattacctgccaaatgctatactgtgtcatggtgatgcaagtcactaaatttctcagtttttgctgattgctaagggaaataacagtatttccacaatagggttcaaattcctgcaaaattacctaccccagttcatctctgctgaacatttggaaaccatgcactagccaacccaactgacttctgctaggtagaggcatttgtcttagagagagagagagcgcgggagagagtgagagagagtgagagcacaaagataacgcaggagagagagagagaaagaatgagaaagaaaaggaatgcaagagaaggagatgtaatgacagagagttctggtgagatacccagagagaaaaagagagagcagggtggggtaaggaggagaaaataaaccaacaattaggtctgcattttctcaggcagtaggcattctttagtctacataggcaaagttttccattttgtcagtctgagtcatcaaaaagagtcttaattttctaaaacaagttggctagaagaaagtaaaaagaacaacacttgttatgaggggcctgtgatattttcacatcttagttaagctccttaagtttgaaggctgcacactgacataatgtagtgagtgtagactggccatgcaagtggttgggccccatttcagaaaatctcagactctaaaccaccagtgattgccctagcatgctccagaattgtcccgcacttagtcactctggttcgattactgttgcgaaaccagtcccccattatgacaatacccagcggggtctttggtaacatggccgagatgaatcaaaacgggcccttcgggcacgttaaacctgctactaaacaggatgggtaaaacactccaggcaaacaccagcgaaagattatatacaacggatgccttgaaaaaatanc

SEQ ID NO: 76 - DNA, 5726 bp, Homo sapiens
ctatgaggaagctatcaaatactatgaacaatatttatctgtcgtgcagagtctgaatcgcatgcaagaccaagccaaggcttaccggggcctgggaaatggacacagggcaatggggagcttgcagcaagcccttgtgtgctttgaaaagaggctcgtggttgctcatgaacttggagaggccttcaataaagcccaggcctatggagagctgggaagtctgcacagccaattagggaattacgaacaagccatttcctgccttgaacgccagctgaacattgctagagatatgaaagaccgagccctggagagtgacgcagcctgtggcctggggggcgtttaccagcagatgggggagtatgacacagccctgcagtaccaccagcttgatctacagatagcagaggaaaccaacaaccccacgtgccagggccgagcctatgggaacctgggcctgacttatgaatccctgggcaccttcgagagggctgtggtctatcaagaacagcacttgagcattgctgcacagatgaatgacttggcggccaagacggtgtcatatagtagccttggaaggacccatcatgccttgcagaactattcccaagcagtcatgtacttacaggaaggtttaaggttagctgagcaactgggccgaagagaagatgaggcaaaaattcgccatggccttggcctctccctttgggctagtggaaacttggaggaggcccaacaccagctttatagggcatcagccttgtttgaaacaatccgacatgaggcacagctgagcacggactacaaactctccctctttgacctgcagacatcatcctaccaggccttgcagcgggtgctcgtcagcctaggccatcatgatgaagccctggctgtggcagaaaggggacggacaagggcatttgctgatcttctggtggaacgacaaacaggacaacaagactccgacccctactccccagtcactattgatcagatcttagagatggtaaatggccagaggggactagtgctttactattccctggctgcaggctatctgtatagctggctgctggctcctggggcaggaattgtgaagtttcatgaacactacctgggtgagaacacagtggaaaactcaagtgacttccaggccagcagcagtgtaacccttccaacagcaaccggctcagccctggagcagcacattgccagtgtccgggaggccctgggggtggagtctcactactcaagggcctgtgccagcagtgagacagagagtgaagcgggagacatcatggaccagcaatttgaagagatgaacaacaaactcaactcggtcactgaccccactggctttctgcggatggttcgccgcaataacctgtttaacaggagctgccagagcatgacgagcctgttcagtaacactgtgtcaccgacccaggacgggacctcctctcttcccaggaggcagagctcgtttgccaagcccccgctccgtgccctgtatgacctgctcatcgcgcccatggaagggggcctgatgcactccagcggccccgtgggccggcaccggcagctcatcctggttctggagggggagctctacctcattcctttcgccctcctgaagggaagctcctccaatgagtacctctacgagcgcttcggcctccttgctgtcccttccatccgctccctcagcgtgcagtccaagtctcacttacggaagaacccgcccacatactccagctccacatccatggcggctgtcatcggcaaccccaagctaccatcggccgtgatggacaggtggctgtgggggcccatgccatcggccgaggaagaggcctacatggtgtccgagctgctgggctgccagcccctagtgggcagtgtggccaccaaggagagggtcatgagtgccctgacccaggctgaatgcgtccactttgccacccacatctcctggaagctgtcggccttggtcctcacgcccagcatggacggcaaccctgccagcagcaagagctccttcggccacccctacacgatccctgagtccttgcgggtgcaggacgatgccagtgatggggagagcatctcggactgcccgcccctgcaggagctgctgcttactgccgccgacgtcctggacctgcagctgcctgtgaagctggtggtgcttggctcctcccaggagtccaacagcaaagtcacagccgacggggtcatcgcgctgacaagggccttcctggctgccggcgctcagtgtgtcctcgtgtctctgtggcctgtgccagtggctgcttctaagatgttcatccatgccttctactcatccctgctgaacggcctgaaagccagcgccgccctgggggaggccatgaaggtggtgcagagcagcaaggccttctcgcacccctccaactgggcagggttcatgctcatcgggagtgacgttaagctgaacagcccctcatcactcatcggccaggccctcacagagatcctgcagcacccggagcgtgcgcgggacgccctgcgagtgctgctgcacctggtggagaaatccctgcagcgcatccagaatgggcagcgcaatgccatgtacacatcccagcagagtgtggagaacaaagtgggcggcatccctggctggcaggccctcctcaccgctgtgggcttccggctggaccccccaaccagtggcctgccagcggctgtcttcttcccaacctccgacccgggcgaccggctccagcagtgcagcagcacactccagtccctgctgggtctgcccaatcctgccctccaagccctttgcaaactcatcactgcctccgagacgggcgagcagctcatcagccgggctgttaaaaatatggttggaatgctccaccaggtgctggttcagctccaggctggcgagaaggagcaggacttggcatcagctcccattcaggtctccatcagcgtccagctgtggcggctcccgggatgccacgagttcctggcagctctaggttttgatctctgtgaagttggtcaggaggaagtaatcctgaaaaccgggaagcaagctaatcgacggactgtgcacttcgcgctccagtccctgctgtctctgtttgattctactgagctacccaagcgcctcagccttgacagctcctcctccctcgagtctcttgcttctgctcagtctgtttccaacgccctgcccttgggttaccagcaaccccccttctctcccaccggtgcggacagcatcgcctcagatgccatctctgtgtacagtctgagctccattgcctcctcaatgagctttgtctccaaacccgagggtggatcagagggtggaggccccggaggacggcaggaccatgaccggtccaagaacgcttacctgcagagatccaccctgcctaggagccagctgcctccccagacccgccctgcaggcaacaaagatgaagaagaatatgaagggttttctatcatcagtaacgagcccttggcgacctaccaagaaaaccgaaacacatgcttctcaccagaccacaaacaaccccaacctgggacagccggaggcatgagagtctcggtgagctccaaagggagcatcagcactccaaattctccagtgaaaatgactctgattcccagccccaactcacccttccaaaaggtgggaaaactagcaagctcagatacaggagaatcagaccagtctagcacagaaacggacagtaccgtgaaatcccaagaagaaagcaacccaaaactggatccacaagagttagcccagaaaattctggaggagacacagagtcatctcattgcggtggagcgtcttcagaggagcggcggccaggtgagcaagagtaataaccctgaagacggcgttcaggcgcccagcagcactgctgtcttcagagcgtcagaaaccagtgcgttcagcaggcctgttctctcccatcagaagagtcagccatcaccagtcactgttaaaccaaagcccccagccaggagctcctccctgcccaaggtgagttccggatatagcagccccaccacctcagagatgtccatcaaagacagcccgagccagcacagtggccggccatcgcccggctgcgactcacagacttcccagctggaccagcctctctttaaactgaagtaccccagctctccttacagcgctcacatttccaaatcaccaaggaacatgtccccaagctccggccaccagtctcctgctggcagtgcaccctccccagctctctcctactcctcagctggatctgctcgctcaagtccagcagacgctcccgacatagacaaactgaaaatggcagccattgatgaaaaggtgcaggctgtccataacctgaagatgttctggcagagcacaccccagcattccacagggccaatgaagatcttccggggggctcctggcacgatgacttccaaaagggatgtcctcagtctgctgaatttgtcaccacggcacaataagaaggaggagggagtggataagcttgaactgaaggagctgtccctgcagcagcatgacggagctccaccgaaagcccctcccaacggacactggcgcaccgagaccacctcgctgggctcactgccgctgcccgccggccctcccgccacagcccccgcgcgccctttgaggcttccttctggaaatggctacaagttcctgtctccaggaagatttttcccttcttccaaatgctaaagcatcttttatacccactgactctgagcagcctgcagatgggggcctggcgtttgcttcagcccttccctgagtgcagtccccccacagccaccagcaccctcatgatgctgtgctctgcaggcgaggggcaccaccacgtccaaaggctgccacacacactggtggcttttctgggccacattcaccaaaagccaggacttctgtggggctggtacaggaggctcatggaatttcctacacacttcaccaaatgtttgtttacctttgaactccctgcttctcatctttgatatgattcttcaccaggattttgtacaaaaatgatcatggttctggggtggggagaggaaagggagcacatattttgctaagaggtatatatgcagtaccttttatacacagaaatacaaatagagctttttctaaggctttcggttgctggttgggggtgggatatatgaaatttcagttgaattctacaggaaagtgttatattagccaaaaacagaaaaatggtttttaaaatgccaatgatttgtaattaaattgtagcaattttggtctcatgatagtgtaatatctcagcaacaatgcaataattcacattgaaacagcgcttccattctgaactctgctctgcaaatgtcttttgggtcccgctgtcaaccaaacttgaattttcttaaaaaaaaaattatgtaactcttatccaggcattttagaactatgcaattgtgatttaaaatgcaactttgtgcttttaaaacattattgaccttttttgtatatggataaacaacttttggttttattatcaatagtactttgcatttatagctattatttttaaaagctcaaaaagttttttaaaatgtcaaattttgaatagtcatcaataagtaattatcaagtttggaaggaaaggttgaaatgactccgtttccttataagc

SEQ ID NO: 77 - DNA, 43632 bp, Homo sapiens
gatcaacagcatcccaaggcagaagaatttttcttagtacagaacaaaatgaagtctcccatgtctacttctttctacacagacacagcaacaatctgatttctctatcttttccccacctttcccccttttctattccacaaaaccgccatcgtcatcatggcccgttctcaatgagctgttgggtacacctcccagacggggtggtggccgggcagaggggctcctcacttcccagaaggggcggccgggcagaggcaccccccatctcccggacggggcggcggcagggcggaggcggacccccacctccctccctgacgggccggctggctgggcaggggctgacccccacctccctcctggacggggcggctggccgggcgggggctaaccccccacctccctcccggacggagcggctggccgggcgggggctgactccccccacctccctcccggactgggcggctggccgggcgggggctgacccccacctccctccgggacggggcggctgctgggcggagacgctcctcacttcccagacggggcagctgccgggcggaggggctcctcacttctcagacggggcggctgccgggcggaggggctcctcacttctcagatgggacggccaggcagagacgctcctcacctcccagacagggtcgcggccgggtagaggcgctcctcacatcccagacggggtggcggggcagaggcgctccccgcatctcagacgatgggcggccgggcagagacgctcctcactttctagacggaatggcagccgggaagaggcgctcctcacttcccagattgggcagccgagcagaggggctcctcacatcccagacgatgggcggccaggcagagacgctcctcacttcccagacggggtggcggccgggcagaggctgcaatctcggcactttgggaggccaaggcaggcggctgggaggtggaggttgtagctagccaagatcgcgccactgcactccagcctgggaaacattgagcactgagtaaacgagactccgtctgcaatcccggcacctcgggaggccgaggctggcggaccactcgcggttaggagctggagaccagcccggccaacacagcgaaaccctgtgtttggtggagaccaaaaaaatacgaaaaccagtcaggcgtggcggcgcgcgcctgcaatcgcaggcactcggcaggctgaggcaggagaatcaggcagggaggttgcagtgagccgagagggcagcagtacagtccagctttggctcggcatcagagggagaccgtggaaagagagggagagggagaccgtggggagagggagagggagaccgtggggagaaggagagggagaggaggattgcattttttaaaaattggaggtaccattgatttaataacttttcagtcaaaaaagactacacaaaatacataaacttttatttatttttatttatttttactttttttttttttttgagatggcgtctcacttgttgccaaggctggagtgcagtggcgcaatctcagctcactacaagttccacctcccaggttcaagcaattctcctgcctcagcctcccaagtagctgggattacaggtgcctgccaccacgcacagctaatttttgtatttttagtagagacagggttttaccatgttggcctggctggtctcgaactcctgacctttagtgatccatccgtcttggcctcccactgcgcccggccataaacttttaaactaaagcatgatctatcgatacattgcagagcttctttcctttagtatctgaaggtttgagtcaaagctgttttcccatctggaatcagttgcccatttggctatccgcccgagcgttgtggtttcctctcctgttcctggcctgcctttgtgactcactctggagatcaccttcgaggttaatggcttgtggaagagttccaagttttatctctgtcctagttggttaaacatcattttctctttttcaagcaagtgaaaagctttcaatagatagatgtttatttcctaagcactaaatgactcataaattaagtccctgtagatttggaaaaactccttaaactgtatctagaggtctagcacttcctagtaggatagacagtcctttctagatactgtaacttttttctgtaccgctttggagtacagtctttatgaagttgtttgtaagcaaaagggaataaaatttaagcctaaaggctgggcgcgatggctcacatctgtaatcccaatgctttgggaggccaaggcaggtggatcacctgaggtcaggagttcaagaccagcctgaccaacatggtgaaaccccatctcaaaatacaaaaaattatctgggtgtggtggcggccgcctataatcccagctactctggaggccgaggcaggagaatcacttgaacccaggaggtggaagttgcagtgagccgagattgtgccattgcactccagcctgggcgcaacaaaaaactctatctcaaaaaaaaaaaaaaatttaagcctaaaattcaaccctgttactacaagtgacttacctgaagttgcagtctgctgaacaggtattttccatacacagctacgtttctctgtagacagcagtgacaattctgtttccgttcatgcctctgcctacctgctggcacatgtctttcaatagcagcagtatgctatatcctgatttcacaaatcttaaaatatgctaaaatgggtgtcttagacccaaggaactgtaagtcttctctggaggcctaaggctgctctgtcagtccccatatccccgggccaggccacgtgaagcaccaaatccactggggtcccttttgcccctacaggtctccctgtcttcctgcctctgtgtcagccaggagctcatcttctgtggctgcacagatgggatagtccgcatcttccaggcccatagcctgcactacctcgccaacctgcccaagccacactaccttggggtagacgtggcacagggcctggagcccaggtactgccctgtggggagagggaatgggaggggcccacccagagtctgtccactggcattcatccatgcttccagatccatctatctgtctgtccatcccacaaatacccatcatgactctcagccctgggcattacaaagcagaaaagtccttgccttccgaggcaagcctcacagtgagaagtgaggctgggtagggggaagaaacagtgagaaaacaaaggaataatatcatttcagatagcggtcagcatggtgaagaacagtgcagagcaggtgtgaatgtggcggagtgtttccatccacatggctgacccctactaagtggctgctaagtgccagccctgggctggaagcaggacatgcctattataatgaagcagcaaaatctctgcctctctgcagtatagcaagggggctcgatgataagcaagtacacgaaaaagataatttcaataggcatgagtgctttggggaacacagcagggactcgggaaggagagtgactggggtgggctgtgctgattgggtgcctggtgagaaggagctgctgtgtggagagctgggtcccagcagttgaggtgacagcacactgggcttgttacgttgcaggaatagtaagggactgtgtggccagagcccagtgtgtccggggaggatggtgggagatgaggccagtgtggggcgcctgtagtctatcctcaggtcagtgggcagttgctggggtttcgggcgttggggtaaatgaccaggccttacatgttaggtccctcagctgctgtgtcgagagtggatagaagcactaggctgtggctttcttctcctttgttgcaagtctgttttatggaattgggggctacctaaccagggggtgccaggtgcctagggctgcctctttgtggatttctggatgctagctcctgggtgccttttccacgacagggcctgaacaggggaactgggtgtcatgaaggaaaggagggggcgagcaacccacaggcagtgttgtgttgtagtagtcgggctcacagctctgctgtcttctgttgtgctctgtgaccttgggaaggtgactatacctccctgtgcttccgttttctcatgtgtaaaatacagtacctagctcttattgtggttgtgagaatttattgcaggtaaaactctcggcctggcacagtgtaaatgctcagtaaactgtagccttcatagggagaccccaggccaagggacagctccccagcctccttaggacacagaggctttttgatcatgcgttggtgaggccaagaagaggtgggacctgagatacatgcctattatctttctatgctcagagagagagcaggagcttgggttgggtgaaatgatgggcgataaatgttcataggaatcaaaaactcaattgctctcggggccaggcaaaaatttccggtttgtagcctctatatgaaaagcaaagcagaggaagagggaagagggaaaagtagaattggagcaggagagatggatggccacaaataccatgagggatggcattgccggggaggcatctccactgtcactagaggtggctgtcactactcagtgacattgatggtgattgattacccatgtggccttgttagcttcctcttccacaggaaggcggaagcagtctacccagatacagtggcactgaccttcgaccccatccaccagtggctgtcctgcgtgtataaggaccacagcatctacatctgggatgtcaaggacatcaacagagtgggcaaggtgtggtcagagctcttccacagctcctacgtttggaacgtggaggtgagccccccccccacccccttgcccctgcttggcctctgcacagttccccacagtttgggaacccattcagtaattccttcagaagatactcattgactccctcctatgcatcaggccctgtcctaggtgctgaggacacagacacaaaatccctgcccttaacaagctcacatttggatgggaaaggaaacctggaaacatcatcagtgaataacacgccaagcagcagtaaccctctgaagaaaaatgaggcggggaaggggaaggggaatgcaggtggtattctagagaggagaggggtcagggaaggcctccctgaggacatatgagcagagacctgcaggaaatcggggagtgagacctgcaactgctggggagaaccacaagcacagaggccctgcggcaggaacatgcactccacagagagctttgctgtggaggtcgtttatgtatttcactgctttttttaaaaaggagttgaagacggggcatggtggctcacacctgtaatcccaacactttgggaatctgaggcgggaggatcacttgagtccaggagtttgagaccagcctgggcaacacaagaccctgtctctacaaataatttttaaaaattagccaggcatggtagcacacacgtgtggtcccagctactcaagaggtggaggcaggaagatcacttgagcctgggatgtcaaggctgcagtgagctgtgattgtgccaccacactcccacactccagcctgggtaacagtgagaccatgtctaggaaaaaaaaaaaagttttgaagtttttattttctgagaatgaatttgtgggtttttaaaaattctctaaagttaaccaggcacagtggctcatgcctgtagtcccagcactttgggaaatcgaagtgggcagattgcttgagtccaggggttcgagatcagcctgggcaacatgaggaaaccccggctttacaaaaaatacataaaaattagccaggcgcgcctatagttgcagctactcggcaggggctgcggcaggggggctgaaaatttcttactgggaatgtttgtcctagagaaattgggttttcagtggccagattcaggatcgtgagaaagaactttgtccttttgaataggcagcattcagcctatgactctggttgaatctgtctgccttcatggggctgacgtttttgttgacagcactttttttccactcaaagaatgttttttaataacttttaaaattcctgtatgaaatttttaaaaatttgggataataggtgaaatattacagataaggctacagtccacattgatgacttccctgcccccagttctgctctctctcgccctcaccattatcaattttattatgggtgtcttcagttgattttctttgcatctccttattgtttatgtatatagctgttcaacaacagtatctgtggatagatcttttcatcagttctagaaaattctcagccaatactgcttctaccctcttctctctctttttttttttcagacggagtttcactcttgttgcccaggctggagtgcaatggtgtgatctcggttcactgcatcctccgcctcccgggttcaagtgattctcctgcctcggcctctcaggtagctgggattccaggcatgcgccaccacgccttgctaattttgtatttttagtagagacggggtttctccttgttggtcaggctggtcttgaactcccgacctcaggtgatccgcctgccttggcctcccaaagtgctgggattacaggcatgagccaccatgcccggcctattcgctctcttctaaggttctatctaactctaaggttctatctgtattcttcatgtttctgaaaataaaaatcacacaaaagatatgtagagtttatcaattattgttagcagctttttttcccccccaagacggaatctggctgtgttgcccagtctggagtgcaatggcacaatctaagctcactgcaacctccagctcctgcgttcaaacaattctcctgcctcagcctcccgagtagctgggattacaggcagccgccaccacgcctggctaatttttgtgtttttagtagagatggggtttaaccatgttggccaggctagtttcaaacccctgacctcaagtgatctgcctgcctcggcctcccaaagtgctgggattacaggcgtgagccactgtgcctggcctgttagcagctattgatgctcagttcctggacccttttatttattgagggttgcaatatggtgatattctaaatctataatttatttttattagttggactacttacgtgaagagatatttgctctcatctgccatttggtcacccagtgctatacttcatataggaaaggcaggagaaatacttgattctttccctttatttaccagttttcaagataatgaattggttccctatcctctaaaggtaactagttttatttaatatcattataaactcatatatatttaaatatatcagatatgttttaatctattgtaattattaactttattggagctcatatcatcccatctttggccagtgagagcctcttaacattggctcctgagccctttggacatgaccctagtatttcttgatagccaccttgctgcctgggatgccaatatgttccagtctcatcttgtacatttcctgtcacacatcaggaatcaaccatttctcgaaaagaccatgtttttttttttgggctgggtgcagtggctcatgcctgtaatcccagcactttggaaggctggggcaggggaattacccgagcccacgagtttgagaccaacctggccaacatggtgaaaccttgtctccactaaaatacaaaaaattagccgggcatggtggcaggcgcctgtagtcctagctacttgggaggctgaggcatgagaattgcttgaacccgggaggcagaggttgcagtaagccaagatcaagccactgcactccaatctgggtgacagagggagatcctatctcaaaaaaaaaaaaaagaaaaaagagaaagagaaggccagggtttttttttagtacaaattgggacttcagaatcacaggttgggtgttagggatgctcatcgctattgggtcgttcttccagaagcctagttcttaaggacacaggggatggtggaattagaatatccccagtaactcatttgctttttcccacattatacatgcaacagtctgagaatggacaacttttcaattctgaagatagttaaaacaattgtaatgcatatgttctctctgttctctccaatttttaaaatagttatactatatttacaggatctgaatatgtagccattatatactatagtgtctcccttttgacccctgtttattttggaatggggaattatatatgtgtgtatatatgtatgtgtgtgtgtgtatatatatatataaaatgataaaatatacatgacatcaagttcaccatttcaactattttaaattgtaccatttggtggcatttagtacacttacagtgtcatgcagccatcattactctctagtttcagaacattttcatcacccacccaccccaaaaaatcctgtatctgttaagcagtcctccccattccccactccccccatccatggaaatgactaatctgcttctgtctttatggatttgcctgttctgaatcttttcttttctctccttctttccttccttccttccttcctttttttttttttttttttgagatggagtctcactctgtcgcccaggctggagtgatgcagtggcacgatctcggctcactgcaagctccgcctcccgggttcacgccattcttcttcctcagcgtcctgagcagctgagactacaggcacacgccaccacacccagctaattttttgtatttttagtagagacgaggtttcaccatgttagccaggatggtctcgatctcctgacctcgtgatccgcccacctcagcctcccaaagtggtgggattacaggcatgagccaccatgccaggctgtttcctttcttttcctctttctttcttttttttttggatggagtctcgctttgtcacccagactggaatacagaggcacaatctcggctcactgcaacctccacctcccgagttaagctattcccatgcttcagtctctagagtagctgggattacaggcacatgccaccatgcctgatgaattttttgtattttagtagagacagggtttcaccatgttgcccaggctggtttcaaactcctgagctcaggtgatctgcccgcctcagcctcccaaagtgctaggattacaggcgtgagccaccatgcctgacctgaatattccttataagtgaaatcatagactatgtgggcttttgtgcctggctttcacttagcataatgttttcaagatttatccatgttgtagcatgtgtcagcacttcatgcctttttatggtggaataatatttcattgtacggatagaacacattttgttctctgttatcagttgacggccacttgggtttttttctaccttatggctgttgcgaataccactgctatgaacatgtaagtacaagtttttttgtttttttttttttgaaacggagtctcactctgtcgcccaggctggggtgcagtggtatgatctccgctcactgcaacctcaggctcccaggttcaagcgattcttctgcctcagactcctgagtagctgggattacaggcacgcaccaccatgcctggctaatttttgtttttttagtggagacacggtttcgccgtgttggccaggttggtctcaaactcctcgcctcaagtgatttgcccacctcggcctcccaaagtgcagggattacaggcgtgagccactgtgcctgacgtagttctttctttcagttacatcactttgtttctgagtttttgtaggttgtttttcataccttggatcattttttaaatatcttttaccttcttttgaaacagtaggcccagcgtggtggctcacgtcggtaatcccaacactttgggaggccgaggcaggtggatcacctgaggtcaggagtttgagaccagcctggccaacatggcaaaaccctgtctctgctaaaaatacaaaaaattagctggccgtggtggcgggcgcctgtaatcccagctacttggggggctgaggcaggagaattgcttgaacccgggaggcagaggttgcagtgagccaagatcgtgccattgcactccagcctgggcgacagggcgagactctgtcaaaaaaaaaaaaaaaaacaaagtaagttatagtttttatctttttttgtgaaaatatgtttctgctgtgcttttttttttttttcttttttaagagtaactattggatttgaccttggtcctttcctgttgttcatttttatgtgataccagtttttctgaaattttagaagttggtgtgcttcaggacagattttccaactacacaagaagaactctgtcttttcttttttttgtgggggtggggtggcatgttttgttttgtttttgaaaaggagtctcactgttacctaggctggagtgcagtggcatgatcacagctcactgaagcctcaacctcataggcacaagcagttctcctgcctcagcctcccgagtagctgggaccacaggcatgcactaccatgcccagctaattttttatttttggtagagatgggatctcattatactgcccaggcttgtttcaaacttgggctcaagcagtcctcctgcctcagcctcccaaagtgctgggattgcaggcttctgttatttttatactgtgttaaaatatggcagcctgctttctgatacttcctttttgtggtcctctttatctgttatgtctcttctttcgtctcaatctcctctttactttatttcttctgtccctgttgtgattggtcaatttcatttctactcttagcagtttctcttcagtgtggagctttgtcctggaaggacaaagttcacaggatcttctccagtccctttaggccttaccccttgcactcaactgctgttggggtggatgaaaccctcctactttcagctgctgttcagtttggcccagtgtgctttccaatgaacacctcttggctactttggaattatcctgttgctgggtctgtcagatgccttattacttctctgtctcccacatgcatgctgatgatatgtaggtcttgtgattggtggtggtttgtcccactcacttgtattttggggtttatgggagtattttgtcactgagttttgctataaatgttgtctgtaggtttgggttttgctatctggttgatgtttttcttatgtcgagattttgggagattaaaaaaattaatgccgctactatcatcttcccagttctcaatcttccgtattttgaaatctctttatatggtggctctttgtccttctcagcttcattctaaatatctttagttttgtctttcagttcacttaattttctcctcagttatatctaatctttggtttttaatgtttttatttttttattattttttttttgagacggagtctccctctgccgcccaggctggagtgcagtggcgtgatctcggctcactgcaagctccgcctcccaggttcacgccattctcctgcctcagcctcctgagtagctgggactacaggtgcctgccaccacgcccggctaattttttgtattttttttttttagtagagacggggtttcaccgtgttagtcaagatggtctcgatctcctgacctcgtgatcctcccgcctcggcctcccgaagtgctgggattacaggcgggagccaccatgcccggcctattttttatttttttatttttatttttttgagatggagtttcgctcttgttacccagactggagtgcaatggcgcgatcttggctcactgcaacctccgcctcccaggttcaagcaattctgctgcctcagcctcccaggttcaagcaattctgctgcctcagcctcccgagtagctgggattacaggtgtgcaccaccacgcccagctaattgtgtatttttagtagagacggggtttctccatgttgaggctggtctcaaactcctgacctcaggtgatccgcccacctcagcctcccaaagtgctgagattacaggcatgagccaccgcgcccggccaatatgtttttattattcatttctagaagctgttctgttttggtctttttcagccctgcttggttaatctttataatttctggttggctgcacacttttaatcttgtcaaaattatcttttagttcttcaaacatattgaatgtagttattttatattctgtctgataattccaatttgggtttttttattttgtttttggtttgtctgtctgtttgttttgagacacagtctcatatgttggccagagtagacttgaactgctggtctctagcagtcctcctgcctcagcctcccaagtagctgggactacaggcatgcgccacctcccctgatttaataattccagtatttaaagtcttgctagactctgttgcttctgctgcttcttgctgatggtacctcgttttcttttgtgcttagtcatgtttgattgagttccacatttcccttggaagtttatttgagggtatgtgttaaggcctaggctgaaggtgggacatggatgatatatggtagcattttgtgtcctttttttttcttgtttatttttagcatagaaggtattgcacgatacctgtttatctttaacttactttttttttttccatgaaaatgcaacagtaagtcatagtgctgtcattgagtcatcctttgccttgtcctctgggaactgtaggtgtatcctgagtttgaagaccagagagcttgtttgccatcaggatcctttctgacttgttcttcagacaacaccattcgcttctggaacttggacagcagccctgattctcactggcagaaaaacatcttcagcaatgtgagtggcttcctttgtgaaccatctttcaggaggaacaaagacctactgtaagcttgaatgcaggggcaggagagagtctgatggaccctagatgttaggttccatgagggcaagagccggcaaccaaggcaggtccctctctgcatcactgcctcttgtttctctttctcctgccccctctctgaggtggcacgctctatcctctctgattctttgccagttggctcctgctctgcagatgtgtggacgtggccactcccggcagcccaacacacccagcccaggtgaaattgcttcctaagtcttgagatggaattccctgggagagcacctgatgagccagcccattcagctgccacacagtgaggcctcacgggggtatgggcagaatgctggcgagagccatgatgggaggctgggaagaaaagtttgctgaggaaattttggttagtattgcaagcccagtgagagggcgtctctggggagctgagacctgagtcatgcattcatttattctgcagacacttattaacgtccatgccaggtgcttggctacatgctagggacacaacagtgactaagactcttctgtcctgtggcacacacaatctagtgagggccgacagtgaactgacagccgaccatgttaatgcacaatcacaagtgcgaaaagcactgtgaaggaaaatgtgcagggtgctagtaggacatagagcagcagcatgtgaacttatctgggacatccggagcagcttcccgcggaagggacagctaagttgagattgggaagagtaaagagggaaggggagagggtctatacttagggaatagcctgtatgaaggccctggggtgggaaacagctgggtgaattggaaaacctgaaagaggccagtgtgattggaactaaaaagaccctccatgcaggaggctgtagcaggtgccctgcaggtgcacctttattactcccctcattccctacccagtgctaccatcgtctcctctgtacctgtgacatacatgctgtttttggctgcacacaatagaaaaactcaaaacaagaggtaaaagttaggtttctgactcatgaaagtagtctgaaggtaaccagtttagaccgttctgcaggaagcccttagggatccaagggccttccagctctctactctgtcatttgagggagcaggctatgtcctcatgacccagtgtggctatgggggctcctgctatcatatctgagttccaggctgcaggatggagaaaagacagcagaagaatacgtgcttgctttatatttaatagttcagaatttattcacatattcttatctagctgcaggggaggcaaggaaataattattctgattggtgaaactcccagctcaaaattagagttgtattactaacgaagaagagactggctatggagggacacgatttcagaggtgcttctgagctgctcgtgctgacctcagccctgtccttcctgcagaccctgctgaaggtcgtgtacgtggagaatgacatccagcacctgcaggacatgtcacacttcccagaccgggggagcgagaatgggacacccatggacgtgaaagccggggtgcgggtcatgcaggtcagtcctgacggccagcatttggcttcaggcgaccgaagtggaaatctgaggcaagtgggccctggcagtgtccagtgtacacctcccagctccagctcaggttctcagggcagtgggcagaagccctggccttggcacctcctgctgcccattgggaatgaggggctgtgaatagtaatcccatgaacagctcccattgggaacttaagctcgtaagaggcttccagaagggctgagagcagagtaactaccaggacctcagcagctagggtgtgcagattttgcctatagagtgtacaggcaagctcacatgactctagggcagcgtgacactttcaccagccacatggtaccagtgctgaactgtcaccgaagatgccagctggaggagggtcctggtggctctgggagaggggctatgagggtgggatagctgagagttcaggctgcttatgtgccctgttgaggtttggcaggatgttaccaacccagtaggtgctagtgggacataggccctgttgctgggaccaggtttaagatgacaaatgacagctgtgaccacctgggtattggagccactggggaatggaggagagttgggggaaactagaggggacataaaggggcagcagccaccaggcagccccaggagagtaggctacaagttttcaaactttcctgttgtcaagaagagcagaaagtgccgatttttttctgtgaaattcgataatttttaaatattggcacctgttttgatatcagtcactgtatgagaccagctcagtgtgtcagtgagctgcttacattgacatggcactgtctggagtggcaaaacggtaccaagagccaacatggggatagtgctcttcccccttggtgggcgctggcctgagcactgtgttgactgatttaatcctctcactgacccctgatgtaagtgatgttattggcacaaggtgtctggagtaagatcacacgggtagaatgaagaagctgggatgactcgatgactgatttcatttggggagaatcaggaaggtctagatttgagactcttttaacaatgagagactggaatcaaatgttctcatccatagctcctatcctggactatgacctctggcccctagcccctggcccctgtcctaccccagggaccacctctgatgcagccctacgtaaacacctgcccccctagaagactgtcctagatccctggggctctgttctggcccaggcaccacaaggggctgctgcctgctgaggtgctccctggttcaacacggctccctttacgatggcaggtttctaaatgagaaaagtggttgtgcatgtctagagtatttggccatgataaggggttctcattgttggtggcctggccattctgacctattctagaagtggtagagcacatggggctggggtgtggggcttcagcgggcggtgtgtgtctcccaggatccacgagctgcacttcatggacgagctggtcaaggtggaggcccatgatgctgaggtgctgtgcctggagtactccaagccagagacgggtgagcccgcagcaggggtggaatgggggtcaggcagggaggcagcccccctggcagggccacagaaaggggtagttggtgtctggtgggactgtggatgacagctgggagttttgtgttcggtaagggcccctgtagctggaccctgagaccagagtggctgggacttcagaaagcaagacacccgcaggcaggactcagcttgacttgcccgctgctggtgccagcacccaagccaaaggggtggatgtatgaatgagtgaattgtgaatgagaagatagattgattgttaggcattattttcaaaaagtttgaagcctatagaaatattgggagaatattataatgaacaccccataggcttcacccaaattcctcaattttttttttgagatggagtcttgctgtcacccaggctagaggggagtggcaccatctctgctgactgcagcctccacctctctggttcaagtgattctcgtgcctcagtctcccatgtagctgggattacaggtgcctgctgccatgcctggccaatttttgtatttttagtagagatggggtttcaccatgttggccaggttggtctcaaactcctgacctcaggtgatccgcccgccttggcctcccaaagcgctgggattagggcatgagccaccacacctgacctttttttttttttttttttttttgagacaagagtctcactctgtcgccctggccggagggcaatgacgcgatctcagttcactgcaacttccgcctcccaggttgaagcgattcccctgcgttcaagcgattctcctgcctcagcctctcgagagtagctgggattacaggcacgcccccaccacacccggctaatttttgtatttttagtacagacggggtttcaccatgttagcctaggctgaaggctaggaccatagtagggtctccagacctcatggtcctcttcattaaaacaacagaaaattccttctgggccatcagatgagatcatgagataggagaagatttccaagtgaagatttcgtttgtttcaagacagagtcttgctctgtcacccagatgatatatggatgatatatggtagcattttgtgtcctttttcttgtttatttttagcatagaaggtattgcacgatgctggtctcaaactcctgacgtcaggtgatccacccgccttggcctcccaaaatgctgggattacaagcgtgaaccaccatgcccggctcctcaagatgttttctaggctgggcacggtggctcatgcctgtaatcccagcactttgggagttacagagttggtggagttatatcctgatgtgattttccccatgttcttctttcgttctctcatcccccatgctgtgtgccccaccaacttgtcttgaaacatatcttcactcggttcgcctctcctgatctcccctctgcctcaggtcatgttattaggcctcagacatagcaagtgaccagagtagggaaggctggtggcagatgggagtctggccacaggcagtcaataggacctgaacaaggcccaggtagccagacctcagagggtgagaggacactggttttggaagaggctgagaggttgccagggctttacccagcacagacccagcaggcaagagcgctgggctctgctggggcgtctgctgtggatgtccctggaggagcgtccatgcgcccatcgagactcatcctccctgagctggtggtgaggaggtgaaatgccagggtgtgggggctctgggaaagaccacacagagctaagggagtggcccttgccaggcttgggccaagttggctacagttgaagaaccaaagaccccttctccgaggactgggcagcttggtcacactgcccttctgggaggccagggcacccacgcagccttcaggaaccagtctcattctctcctctcacagggctgaccttgctggcctcagccagtcgggaccggctgatccatgtgctgaacgtggagaagaactacaacctggagcagacgctggatgaccactcctcctccatcaccgccatcaagttcgctggtgagcccctttcttcccgctccctgcgccttgctagctaccctgctaaaaaaggattcattctttcaactctcctgtaaaatatatatccaaacaagtgaatacagtatctgtgtacagtatacagaataatgactggggccgggtgtaatggctcacacctgtaatcccaacactttgggaggccaaggagggtggatcacctgaggtcaggagttcgggaccttcctagacaacatggtgaaaccccgtctctactaaaaatacaaaaatttgctgggcggggtgttgtttctgtaatcccagctactcaggaggccgaggtgggagaattgcttgaacctgggaggtggaggctgcactccagcctaggcaacagagtgagaccctgtctcaaaaaaaaaagaataatggccaggtaccatggctcacacctgtaatctcagcactttgggaggccaaggcaggtagatcatgaggtcaggagttcgagaccagtctggccaacatagtgaaaccccatctctactaaaaatacaaaaaaattagccaggcatggtggtgtgcacctgtaatcccagctactcgggaggctgaggcaggagaattgtgtgaacccgggaggcggaggttgcagtgagccaagattgcgccagtgactccactccagcttgggtgacaatgcgagactttgtctcaaaaaaaaaaaaaagaagaatataggccgggcgtggtggctcatgcttgtcatcccagcactttgggaggctgaggcaggcagatcacctgaagctaggagtttaagaccagcctggccaacatagtgaaaccccgtctctactaaaaattcaaaaaaagtaaccgggcatggtggtgcacacctgtaatcccagctacttgggaggctgaggcaggagaatagcttgaatccaggaggccaaggttgcagtgagccaaaattgtttcactgcactccagtctgggtaacaagagcaaaactccatctcaaaaaaaataaaaataaaaaataagctgggcgtggtggccgaagtgagtatccacagttcttaggagcaaggtttgaactaggacgttgttgatagcagagactgttctaattgctcatggtcgtaatattgttaaatacggtacttggattcaccacgtgcaggttaagaagcagaacattaccagaggcttgcaggccttctctgggtccctcccaggttacccttcctcccttatatggggctcactcccttctgtgagccaatgactcctccttgagcaacatctaatacttgtatgtcaggcctggaccctctcaaatgtcctgtcatgaaggagcatgtgtgatgtgcccagactcagagttttatatttgttctgtcatttcatcctcaccaaactgttattctgtaaagaaatgagacggccgggggcatctcacgccattgcactccagcctgggcaacaagagcgaaactctgtctcaaaaaaaaagaaatgagaataataaaagcaagaatgtttctaatgcttaccatgtggcagtccctgttccaagggcttcacatcactctccagagaaggaactgtcaccatgcccattgtacggaccggaagttgaggctcaaaggggaggcccaggttcagagcagtgtttaacagctttgaccttggcaccagagaatgcctgggttcagtcctgcccctgtcctctctgtgtgccttgggacaaggactctgtgaacctctgtgttcatgcttgtccagtgggatgggtggtgagcattcaggaagacccgctacatgcatggggcctggcccaaggctcatgtggatcttgcagttgatcctgatggcacgagcctcccagcctgtctccactggtcgctgctgcagtcctgcctctactccgctactcaagtcacctatctcaatcccagactggagagggtgtcccttctttgtccccagcctttgtttctctatatgcccttgctctgcagagcctgccttggccacagctccacctgtgccccctcacacgtacagctcataccttacagagtcccacccagacccagcacccacctcaccacctttaggaagccttgatcccagcacagttgattgatggctcttgcagtggagttccccagctagggtcccctgcccatgtggcccagccctgcctaacacacagcgtcctcctcccctaggcaacagagacatccagatgatcagctgtggggctgacaagagcatctactttcgcagtgcccagcaggtagggtggcatggcctccttgggggctggggtggggggttgtcggggcattctctgaaggtcctgccggccctgccagggttcggatggactacactttgtccgtacccaccacgtagcagagaaaaccaccttgtatgacatggacattgacatcacccagaagtacgtggccgtggcctgccaggaccgcaatgtgaggtaaggggtggccctggacccttagctggcctggtctgccttgtcctaggctgtctgctttcctccctctgttcctctggtccccaagaagctgggaaggaattgagggacccagcaggtgttccttcttggtttttttttgtttttgtttttgaggcagagtcttgctctgttgcccatgctagagtgcagtggcaccattttagctcactgcaacctccacctcctgggttcaagtgattctcctgcctcagcctcccaagtagctggaattacaggcgcctgccaccatgcctagctaattttttgtatttttagtagagacgaggtttcgccatgttggccaggctggtctcgaactcctgacctcaggtgatattgcccacctcagcctcccaaagtgctgggattacaggcgtgagccaccgtgcccggccaccagcaggtatttcttagaagctgggctctcccaagcctggcctccaggtcagcagagggctttcttctggctctccctagagccggtgtgggatgactaaggtgctgatgtggcacataaactccctcattcacccgtattccctgagcacctaactgggctggatggtgctgggatcatggcagtggccaggatagccccaggccctccttcatggagctcacagtccagtagaatggacacggccacctcacagccacagacagtgacagagtggtcagagatgggggagcccaggggccctgtggagacacctgaccccacctgcggatcaagcaggacttcctggaggaagagacaccttagcctggggaggatgtggaggagcgagccagggggaggcagagagtgagtgtgcagagggcaaagcagtgcaaagaggctctgcaccccttcccagttctttctcatgcggtgccaagcactgagcttgcagtgtgtgggggagatgaacattaactcagtggataccccaggacaacctcagcttgagatggggtttcagtttcagtctaggcatcagatggggacaagaggtagcagggggcttccaggggaggggaggacagcaagagccagagaatgaggtggtggggtaggcggggccctgttggccgcaacatgcccctacttccccagagtctacaacactgtgaacgggaagcagaagaagtgctacaagggctcccagggtgacgaagggtccttgctgaaggtgaggagttggagacccctgtctgtctgctgccctgatgggccacctattgtgacggcccacacctgagacctgtgcccttggtccttcctcagtgcaccgcgctgcccagcaccttctcaggcctggttaaacaaggatgcttgcgagagggtggggagggtgaccccagctgtgtttcctttatttacagagcccttccccaagtggggcgtctaagtgggttccattttgagtggcagcagggtatggtgggaagaatcagaggcatgaactcccctcctggtttgcccacaccagccacgggtcactcaggacaaggggggaccttctcagagcctctggtctaggacagttatgggttcaggttctgcctcaggctgactgtgtgaccttgggcaagcatcatctcttgaaatgcacacagacagcttgtctcatagacttgttctctggaggagttcagtttgcacatgttcagtgcttagcacagggcctggctactgttgttactgctgcggtggttgttaatttcttcacgtgtcgaatgggagcgggagctcctgccctgccagagtcccatgtgctgtgcatgcagcacgggggagggaggggcccaggcctcatcataaggaagaagcaggcagctggagtgacatgtgggtccctttcctggcaggtccatgtggacccctcaggcaccttcctggccaccagctgctctgacaaaagcatctcagtgattgacttttactcgggcgagtgcattgccaagatgtttggccattcaggtgggtgtgcctctctgcttgggatgcctccccacccgcccacaccctctgactccgaaggcaagtgcagcctctctgctttgtttgcagaaattattaccagcatgaagttcacctatgactgtcatcacttgatcacagtatctggagacaggtgggacatggacctttgggagagttgtggctcagataccatgagcactgcactcagcctgcctgtgtagagagcatttctaaactgcccagtttggattgtgggagtcttggtgtcacacccagccctgagttcaaataccagctctaagctgggcatgatggctcacgcctgtaaccccagcactttgggacgctgaggcgggtggatcacttgagctcaggagttcgagaccagcctgggcaacatagcaaaaccctatctctacaaaaaattagccgggtgtggtcatgtacacctctagtcccagctactcaggagggggaagatggcttgaacctggtaggtagaggttgcagggagcacagatcatgccagtgcattccagccttggtgacagagcaagaccccgtctcaaaaaaaaaacaaaacactaaaaaaacatatcccagctctgccatttattttcttgtcaccttgagcaggttatttcccctgagcctcagtttgctcccctgtaaaagacaccaccgtttacatttaccttaaaaatggtgtgatgaggccgggcgcagtggctcacgcctgtgatcccagcactttgggaggcctaggtggatggatcatctgaggtcaggagttcaagaccagcctggtcaacatggagaaactgtgtctctactaaaaatacaaaaattagctgtgcgtggtggcaggcgcctgtagtcccagctacttgggaggctgaggcatgagaatgacctgaacctgggaggtagaagttgcagtgagctgagatcgcgtcactgcaccctagcctgggtgacagagcaagactctctcaaaaaaaaaaaaaaaagaaaattgtatggtgagaaatgaatgagatgatatacatacattctttagcacatgggtggtactcaaggaagtcccttttgtcactccctttgatttaccccagttcttccccacagcccccttcctcaggtcttgaggcctccagaacaggccctggtttgctgggatgccccagacctgggcccagggtgtggatgtggcaagtccagcacccctgcactaagcggataggggtgtgttttccaggagcatctggagaatggggtccaggctgtggtgtgggtggcttcagggtcagccacggcagcggctcccatgcttactcttcctctgccttgtgtgtctctctttgacctccgcagctgcgtgttcatctggcacctgggcccggagatcaccaactgcatgaagcagcacttgctggagattgaccaccggcagcagcagcagcacacaaatgacaagaagcggagtggccaccccaggtcctggcagcccctgcctgtccaccagagggatgagtccctgccagggccccatggagtgatgctggggacacagtggtggccaagacagccctaggccctgcccttagcacactcacagctgagtaggggagacagactttgaatatgcagttacagtaatagatacaaaaaggttttgtggatttttttaattttcgtaaataatagagacagagtcttgctgtgttgcccaggcttgtcttgaactcctgggcccaagtgatcctcccaccttggcctcacaaagtgctgggatcacaggtgtgagccactgcacccggctatgagaagggtattaaagtggaaaagcaaagtgtttggcgagcctctcagcactgtgatgggggatgccccaagcggctgtgggaacagagcagtccctgaccggccagccaaggggaggggtgggtagacaggggatctgaggggagggctgcagtggggccacgtgtcctcttactcccacgtgaaagctgtagcttcacttacttctttgaatcttctaaatatatttctttcaagtctttatgtagcaaagccaattttatttgcagagaactcatgttctggtttttgatttgaggttttggtttgggtattgctcattttgagtgggaggttttttggttttcttctcttctgctgctgggtgtgtctgtttttgccattggctccatgtggctcccagggcaatgtggagaccaggccttgacatgggccactggtcctgaggtcctgaggtggtgttagagatatcttgcttttgaggctcccactccacccccaagctatgaaccagggccctggcttcagtgcctgcctcatgccaagggtgttttagtttcccgtactcgggaagagccaccatcattgctaccacctacaggaagcccagcacaggactgcagccccgctgtctgcttggctttctgtcccattgctgtggccctgagagtttgcattcgtttgtagcctggcctttgttaatctcatctattgtggtgatgtgtttctagtggggagacggcatcaagtgagagacttgccagcaccatcttgaccagcagccaagaatatgttcacatggagcttagcacagggcccagccctaggcaagtccccaccaccagcccatttgcctgtattctctccttaccatcctcattcctggctttaggcaggatacgtatgtgtccacacctagtgagattcactccctgagccctggagagcaaacagaggatgatctggaggaagagtgtgagccagaagagatgctgaagacaccatccaaagatagcttggatccaggttggaaaaggggccctattttgaactatgtcagtgtagggaatcattgctgggttttgcccatgaccttgtttacagggcctggcacatattaaaactcaggagtcgacagggtgcggtggctgatacctgtaatcccagcactttgggaggccgaggtgggtggatcacctgaggtcaggagttggagaccagcctgaccaatatggtgaaaccccgtctcaactaaaaatacaaaaattagccgggcgtggtggcgtgcaactatagtcctagctactagggaggctgagacaggaaaattgcttgaacctgggaggcagaggttgcagtgagctgagatcgcgccactgcactccagcctgggcaacagagcaagactccgtctcaaaaataataataataataataatataaataaaataaataaaattcagtaatcaggcttagcgtggtggctcacacctggaattttagcactttgggaggctgaaatgggagggtcacttgaggccaggaggtcgagaccagcctgggcaacatagcgagagcccatctatgcaaaaaaaaaattttttaaagaaattagccaggcatagtggcacacatctgtagtcccaactacatgggaggctgaggcaggaggatcacttgaggccaggagtttgagaccagcctggcacgtaccaagaccccgttcctacaaaaagaaaaaaattagccaggcctggtggtgcacacctatagtcccagctacctgaaaggctgaggcaggaagatcgcttgagcccaggaattccatgttataatgagctatgattgcaccactgcactccagcctgaataatagagtgagatcctgtctgtagaaaaagaaagaaactcaataatcatatcagtcaagactctttcagtataaaagcaaccaggcttaagtcaggaagaggattttttggtgcctgaaaattggagaggattagctttcagcatggctagatccagatagacagatgatgttaaaaggaagatttttttttgtatcttttggctctgcttttcttcatgttggctttgctgatggacagactgtccctttactaggggaaaagatacccccagcaactacaggcttataaaactccatagagaatagaacacctctttcctatagtagctcaagcagagtcttagggttgtgtggctcatgtttctggtatctgctgtacccacttctgagccagttgttgtagctgtccacatctcagcatgtgatcacttctgagggcagagactgtagtcagctccatccactcacaccacctgaccaggcatcaaagatgtgtttgaggccgggtgtggtagctcacgcctgtaatcccagcactcagggaggccgaggcgggtggatcacctgaggtcaggagttcgagaccagcctggccaacatggtgaaaccccatgtctgctaaaaatacaaaaattagctgggcgtgatggcgtgcgcctgtaatagcagctacttgggaagctgagacaggagaattgcttgaacctgggagacggaggttgcagtgagctgagactgcgccactgcactccagcctgggtgacaaagcaagactccgtctcaaaaaataaatgaacaagtaaaaataaattgaattatgttgcggatattgtccggaatctttttcctctgcaaagtctctcatctacctgtatgttggtgaatacaaagcagacgcctgcgaaattttaagttattcccctccaggtggccatttaggtttttcctgattgcacatcactgttaatgaggctatggagtggagaccactcctaagcctcctcgaaatgtgaggacttctccaggagagagtctgaggagtagcaccactggatcctggagttattttattttactttaaaaaagttgttttattattttatttcactatttttgttgcccaggctggagttcaatagcacaatcatagctcactgtagccttgacctcctgggctcaagcaattttccctccttagcctgtggagtagctgggaccacaggctcaagctcccacacccagctaaatatgtgtgtatcaggggatggtgtgtgtagagacaaggtctcactgtgttgcccaggctggtctcaaacccctggcctgaagtatcctcccacctcgacctctcaaagtggtgggattacaggcttgagccagtatgcctggcctttattttaaaagagaaccccggctgggcgcagtggctcacacctgtaatcccagcactttgggaggccgaggcgagcggatcacgagttcaggagatcgagaccatcctggctaacatggtgaaaccccgtctctactaaaaatacaaaaaaaaaaaattagccgggcatggtggcgggcacctgtagtcccagctacttgggaggctgaggcaggagaatggcatgaacccgggaggtggaggttgcagtgagccgagatcgcgccactgcactccagcctgggcaacagagcgagactccgtctcaaaaaaagaaaaaaaaagagaaccccaagagttctccaaacccagttactgccccaccctgcattgcattaggctctccattgtccccacacttttcctgccatcctttggtagtattaagctttttcacctcggtcagtctcgtgagtcaaatatcgcatcccacggtttaagtttgcatttccctaacccccggtgctgttgagccttctgacttctgggttgtggtgttgcctctttggggactgcccggttatgtatgtggcctgtttgttgggttgtttgtcctcttttcatggattctgtgtctttccagatcctcgttgcctgctaaccaacggcaagctgccactgtgggcaaagcggctggtaagtcttcagggagagggttgctcaggggctggcagaggaaacgcctccccagctctgccttctggaagccctttttcctttccatgtccctcttttccctggagaagccctgtcatccttccaggctcagtgagacagccctttgttcatgatcagtgctctctgccaggcattgttctggatgtcagggacacaacagtgagcaagggaaacaaaagtctctcccttcacaggctcacttgcctgtgtgggcgaggaacaatatccccattaaataagtaaatgacgtagtaggttgggtgctgataagtgctgtggagggaaaagaatcaagaaggaaaatacgtcagccaggtgcagtgatacgtgtctgtggtcccagctactcaggaggctgaagtgggaggatcacttgagcccaggaggttgaggctgtagggaactgagaaggcaccactactacactccagcgtgggcaacagagtgagatcctgtctcaaaaaagagaaaaagaacaggggcccagcacggtggttcatgcctgtgatcccagcactttgggaggccaaggcaggttgatcacttgagcccaggagttcaagaccagcctgagcaatatagtgagaccccatctctacaaaaaataaaaaaattagccaggcatggtggtgcatacctgtagtcccaggtactcaggaggctgaagtgggaggattgtttgggccagggaggtcgaggatgcagggagctgcactccacagcactccagcatgagcaacagagccaacactttgtctcataaaaaaaataaaaataaaaaagaaaataaggagtgttggggggtgtcagttttaagtaaacaggaaaggcctcattgggaaaatgatgtttgagcagagttgaagcaagtgagacaggcagatactgggacgaatgttctagtcataacagcctatacgtgtaaaagccacgaggccaggagctcgagaccagcttaggcaacataatgagactcccatctctacaaaagattaaaaatagccaggcatggtggtgcacacccatagtcccagctactcaggagcctgaggcaggaggatcacttcagcccaggagttggaggctgcagtgatcgtgctactgcactccagcttggatggcagaacgagaccttgtctcttaaaaaaaaaaaaagaaaaagagaccgggtgcggtggctcacgcctgtaatcccagcactttgggaggccaaggcgggtgtaatccaaggtcaagagatcaagatcatcccggtcaacatggtaaaaccccgtctctactaaaaatacaaaaattagctgggcatggtggtgcatgcctatagtcccaactactggtaaggctgaggcaggagaatcacttgaacccaggaggcagaggttacagtgaaccgaaatcatgccactgcactccagcctggcgacagagtgagactccctctcaaaaaaaaaaaaaaagaaagacaatgtggattataagagacagaataagagaggtgaatgaaggatgatcccaaggttggggcatgagtaactggaaaaaacaactgaaacagggaatctttaggaggagcaggtttgtgcagaggaaatgagttgagttgtcagcatgttaactttgaaatacctaccagacatccatacagaaatgtagagcagtcacatgtgcaattctgaagtttcagagaaaagttcatgaatcccagctgggcattcccagcactttgggaggccgaaacaggattccttgagcccaagggtttgagaccagcctgagcaacatagtgagagtccacctctaccaaaaaccaacaaaatgggctgggcgcagtggctcatgcctgtaatcccagtactttgggaagccgaggcgggcggatcacttgaggtcagcagtttgagaccagcctggccaacatggcaaaaccccatctctactaaaaatacaaaaattagccaggtgtggtggtgggcacctgtaatcccagctactctggaggctgagacaggagaattgcttgaaactgagaggtggaggttgcagtgagccaaggtcacgccactgcactccagcctgggagacagagcaagacttcgtctcaaaaaaaaaaaaaaaaaaaaaaacagagaaaggttcacgctggagatatgtacctggaagttgtttctgaatggtattgaaagccaagagtccagatgggctgtgtgaaatgtccgtgtcgctccctgcagtgagtgagcactcagccagttgcctgactgtccgatatccttcaagctaggggacgatgatgtggcagatggcttggccttccacgccaagcgcagctaccagccccacggccgctgggcagagcgggccggccaagagcccctcaagaccatcctggatgcccaggacctggattgctactttacccccatgaagcccgagagtctggagaactccattctggattcactggagccacagagcctggccagcctgctgagtgaggtacacacttccaccgcagcctggcccatagccccggcaccgtgacggccccagggcctggcgccttaggctgactcccactccatgggggcagggaggattacatgagatggtgaagggcaggagggtgagccccaggtctgttgcacagcaagacttcccaaggcagacagggagtctttggaaagtgggtcacttgggggttaagagcttggatgctagagcaggcttgtacccaagtgggggacatttgggtagatcgagccctgaccctacccattcctgttgtgtgacctggagtaagaggcttacctctttgggcttcagtcttctaaaaagtagtcataatggggtcaggggcagtggctaacacctgtaatcccagcatttggggaggccaaggcaggaggattacttaacgatcacttgaggagttcaaggccagcctaggcaacgtagcaagatcccacctctacaaaaatattttttaaatttttttgtttgttttgtttttaaatggtaataacaatctcttctgccccagagggcttttacaggaatccatgcttaagtatagggcctgggctcttagaggtgcccgtgcaactttagctctttctctactattttccaaacaaaattcatttttatcctatcctataatttgtcatcttcattgtggtataatatacatccagtaacatgcacagattttaggtatacagcttgatgaactatctgtgtaattcacgtgtgtccactaccctgggcaaaatctggagtgttttctacctcatagaaacccccttctgcccttcccagtcaggtccccgcaccaggataaccagtgttctgacctctcaccaaggactgggtttcctattcttgaacttgatataaatagacacgtagagggttgggcctcctatttttggtgccacacctcttcctcatctgtaaagggactgataatgcaggggcagaccaggacaagctggttgcgagtggagggcatggcacaggccctggttcacagcctccagcagtggggctgctggcatggttcctggcgcactgttggtggccccagccatgcctgcctcagaatggctgtgctgtcttccccatagtcagagagtccccaggaagctggccgcgggcacccctccttcctgccccagcagaaggaatcatctgaggccagtgagctcatcctctactctctggaggcagaagtgacagtcacagggacagacaggtgggtgtcctttccaccaagggagccttagttggaggaacccccagctgatagctgcatcctggaagaagtgctctctgccttcccagtgggcttgtgggagtggggacagttgaggcctggatggggcaggagcccagccttagttccctggttccaggtggggtacaggagggcctgacctgggggaaggagggggcatttggaggaggcggggaggctgtcgcagtgctcctgcaggagcagcgggtacaggtgcctaggggctccgggtggggctagctgttgagtctccagctgaagtccttgttccctctctgcccccactggcactgcagccagtattgcaggaaggaggtggaggccgggcctggagaccagcagggcgactcctacctcagggtgtcctccgacagcccaaaggaccagagcccgcctgagggtgagtgcagggcaggcagggaccctgtgacagtctgtgcgttcagccaagcccctttctgggcaccgatggtgactttgacccagtactgaagctcagagtctgtcgaggaagacacatgtggtccctgctgctgcctgaggattctgggcccagctgcctacagctgagagcccagctctgccacctccttgatgtggaacttcccttattcataaaatggggggcagctgctcttaccatccctcctccagatggggaaactgagcccagggaagggtagccctggccctggctcaccagaatggtcaggctgtgggctcctgaccccgactctgtccttcagactcgggggagtcagaggccgacctggagtgcagcttcgcagccatccactccccagctccgcctcctgaccctgcccctcggtttgccacgtcgctgccccatttcccaggtaagcaggggccagacacgcaggggactcgctgctcgggcctggcttagggccagtcacaatgtctaagcacaggccctgcacttggagcccactgagcctggaagacggggatccctgcttctcagcctgcgggcaacagggcagggatgggtggggcccgctttctccatttcaggtggcgtctgctgtgactcatggtgttggctcctcttgtccctcccctccttccctgtcaggatgcgcaggtcccacagaagatgagctgtccctgcccgagggacccagcgtccccagcagctccctaccccagactccggagcaggagaagttcctccgccaccactttgagacactgactgagtccccctgcagaggtagggccctgcctcacccacacctgccgaggccgtctgtgcagcctgggcacagcattggcgtccctggagttggctccccagcagggccaggagggtgagtggagagcaactgcttcgttttttttgagacggagtctcgctctgttgccaggctggagtgcggtggcccaatcttggctcactgcaacctccgactccctggttcaagcaattctcctgcctcagcctcctgagtagctgggattataggcatccacaaccacgccctgctaattttttgtatttttagtagagatgaggtttcaccatgttggccagactggtctcaaactcctgcctcagatgatctgcccgccttggcctcccaaagtgctgggattacaggcgtgagccaccgtgcccggcccactgcttcactcttgacctgagcctcacgatgcctcctcacccactgcccctgctcgtaccctgtgtctgtacataagggtttctggggagtgccccgctgggctgtgggctggcctagggccagggctgctcggcgggaagggttatgagggtcccctcgggatcttcccctagagctcttccccgcagctctgggagacgtggaggcctctgaagctgaagaccacttcttcaacccacgcctgagtatctccacgcagttcctctcaagcctccagaaggcatccaggtagaagctggccaagcactgcccaccctctggctcctcaacagtgccccagggcaggctgaatgagaatcatcccccctgctctcctccccacaggttcacccataccttccctccccgggcaacccagtgccttgtgaagtctccagaggtcaagctcatggaccgaggcggaagccagcccagagcaggtactggctacgcctccccagacaggacccacgtgagtattgggcccacctccgtcagggcacggggctgggaaccctgaggccttgtcctcacctcagagctgtgcctgcaggtcctcgctgcagggaaggctgaagagaccctggaggcctggcgcccaccacgtgagtgccccagtcccagacggacagtcctgggtttctcggcgagtggccggatgtccagcctagctgtggggcgtgggggccctagccatcagttctgtgtggtggagtcagtgccatctgcttccgttacagctccctgccttacgagcctggcgtcctgtgtccctgcttcctccgtgctgcccacagacaggaatctcccaacgcccacatctgcacccaccccaggcctggctcagggtgtccatgccccctccacctgttcctacatggaggccactgccagctcccgtgccaggatatcacgcagcatctccctcggtgacagtgagggccctatcgtggccacactggcccagcccctccgtaggccatcgtccgttggggagctggcctccttgggccaggagcttcaggccatcaccaccgcgacaacacccagtttggacagtgagggccaagagcctgccctgcgttcctggggcaaccacgaggcccgggccaacctgagactgaccctgtcaagtgcctgtgatgggctcctgcagccccccgtggatacccagcctggcgtcaccgtccctgcagtgagcttcccagcccctagccctgtggaagagagcgccctgaggctccacggctctgcctttcgcccaagtctcccagctcctgagtcccctggccttcctgcccaccccagtaacccccagcttccagaggcccggcctggcatccctggcggcactgcctccctcctggagcccacctccggtgagtacagccctggagcaaggactgtcccctaagctcatcctgtgtgctagttggctcagctccaaagatggatacttgacctggccacagggactgtgccattcattcattcgtgcattaacttaaatatttaatgagcattacatgttgggctttgtgctaaaccctgggacatgggacatggtggtaaacaacacagagaactgacagcttcaatggggacaatgcccagactaaacctttaaggaacccgtcatatgtatcacgaagtgacacatgcttaggagggacagaggagggcgagggagtgcagggtggggacaggggttgggattacaaaccagaagataagaagaggcttcagggaggaggctgcattggagcagagacctgtaggagtgaaggggagggagccttggggacccagagaagtgttccagacagaagtacagcatggagtccacccagtcgctctggccgctcacaccaatggaatgcagctcatcttgctcattcccttctctctaccccaggtgcacttggtctgttacagggcagccctgcccgctggagtgagccctgggtgccggttgaagccctgcccccatctccccttgagctgagcagggtggggaacatcttgcacaggctgcagaccaccttccaagaagccctcgacctttaccgtgtggtgagctaagccccagagttgggaaagggttgaggggtctcttgagaccgcccggccttggtggcccctgacaaggctggcatcccttgcagttggtctccagtggccaggtggacaccgggcagcagcaggcacggactgagctggtctccaccttcctgtggatccacagccagctggaggctgaatgcctggtggggactagtgtggccccagcccaggctctgcccagcccaggacccccgtccccaccgacgctgtaccccctggccagcccagacctgcaggccctgctggaacactactcggagctgctggtgcaggccgtgcggaggaaggcacgggggcactgagggcgcagcccctccaccgcagccctgctgcttctgaggacttaggtattttaagcgaataaactgacagctttgaggaatggttcctggtgtctgtttgggcctatccacaaagccctcttcaagtggaagtggggagggagggtagaaggtgatgcccagaggactcgtgtctgtcagtggagagcatgggaccagcgctcccaagaagttcaggaactgcagccatgacctcagggccagtcctcccacactgcccacagagctgccacagaccagtgtgaggtgcttacccagtggggcccatttgtgccccagggaggagccagaccctcttacctgccccctgccagtgcctgagaactcactggggctgctgtgatcaccatgtgcctaccttgcccagcagtccacgctttgccatatcatggctcagggcctctgggccaaggccacactagatcccacaaagtccacggtggtggtgtccccatctgcaacaggggaaactgaggacccatgaacaggcttgcccaagctgggtatggtggcctgcacctataatcccggctactcaggaggctgaggtgggaggatcgcttgaggccaggagtttgagaccagcctgggcaacttggtgaaaccccatctctttatttcatgtatttatttatttatttttgtttttgagatggaatcttgctgtgtcatccaggctagagtgcagtggtgcgatcttggctcactgcaacctccgcctcccgggttcaagcgattctcctgcctcagcctcccgagtagctgggattacaggcacccaccaccatactcagctgatttttgtatttttagtagagacggggttttgccatgttggccaggctggtctcaaactcctgaccttgggagatccgcccacctcggcctcccaaagtgctgggattacaggcatgagccaccgcacctggccaaaaccccgtctctttaaataaaacaaaataaaacaagaaacccaggcaggcttgcccactgtatgatcctggcagcaggcccaggccacgagcagctgggaccaataactgcttccccttcagaagttctacattccacgagctcccagcactgctaccagctcccccagacagcaggcatctggccacatggggtgtctgctaaaaaagccactcttggctggggtgtggtggtgcacacctgtagtcccagctactcaggaggttgaggcaggagaatcgctcaaacccaggaggcagaggtttcagtgagctgagatcacaccatcattgtacttcagcctgggtgacacagcaagtctcaaaaaaaaaaaaaaaaaaaatcctgccagttcccacccaggtgccgggcactgtagcagaaggaacatcaggcaacgcacctgccctcatggccactcaccttctatacagtcaaacagatgcaggaattagagctctgtataattctagataggttggggagatccattgctggtgaagggtcagggaaggcctttcgaggtgacatttgggctgaagcttgatagaggacatctcaggaacacatccaggccgacagcacagccagtgcacaggcctggggcagccacacgtgatctgtgtggaagcaagaggagcgaagcccggacggctggaatggagtgagcaaggggagggcaggagctgaggtgcaaggaggagcagggccttgttgcttcataacatttaagtccaaggaatatccagaacagttttttgtttttgggtttgtttctaaatctctgctcttaatgtttgggggatatccagtgttgcttatttctcacgactctgcctcagggagtccaggtggtccagaacttgaaccacctgcctaggcctaggcccatctgcctagttcggccaccattgcccaaaaccttgcccaacatccctgggcaaagcttggtgttcagccccccaggcctcggacacccaggagaccaccttgggcctctgtcatgcatggaattacccttccttccaacctgtatcatagtaaagtcttctgctccaaggagtaaacacctggctttcagggcccaagatggagggacgttggttacccttgatgtcatcatgcacctggcctcttcctctcctgctctgttatcctctgtgagcaagcttcagtctccagcttatggcctcatggttgcaacacggctgctgtggcacccagcagcacaccctcaggtggtgtctccattttgcaattgttggctttcctgcagccctgactgaagtgcctggcataagcctggaagcgcaggagctagaagctgccccgatagtactgctatggggaggctgaggttagatgtggagtgcagggggctcacagagggtgacagcaggagaggaagaggccaggtgcacaatgacatgagggtcagaggcccaagttattggtcccagctgctgggtggcctggtccaaccaggagcaaaggcacagagcagggcaccctctagggcagcagaaaagatgcagatctctcccaggggtctccctgggagactcatctggggtcagatgagtcccaggcaacaggaatggagattgctttgatgtgcttggaccatctctcctgtcctgggcatgttgcagctcaaacaaagaggttctctcaataagaaaggcaagtgggctggtaatcagagaggatccagcatgtctgccacttccctcttccaaatgccaggctctgtcctggaaggaccatactttctccatacttcttaaccaggataaaccacctggttaagaagccactgctggtggtgcagcatgtgtgcatgtggtttgtgagctgacagggtcccagcagaaagatgacagcatgcttagatgggatattccaaagagtttaaccaagggatcatttgcaaaggagcagcagggactgggaaaccaccgaggctggtgcagaaccccaggactggcaccctgggagctgttaccacccccaggccacaaggcacaaagagaaggaacaagaacccaaaagagcaaatcccagggagagggtagtgctgagggagctgcagccctgactcccacacaggacggagtgagaatcaacaccctgaccttactcccctcctgcagggcaccccattgtccaaatcctactggaagccagagtgcatagaagcccaggtgaccccgcctccagtcaacctcctaggccatggagcagggcagaacaggactgagagggttcctggggaactgggtccctggaaggaaaacagttcatctttcactgcaactccccccctgcttctacccccacatctacccttggcctccccatagcagtaccatcaggacagctcctgggtcctgagctgccaggcccgtgccaggcatcccagtcagggctgcaggaaagccaacaattgcaaaatggagacaccacctgaaaccccattttgcagatgacccacctgaggcctggatgtttgcccagaggagggattcctcggcaggatgcagtggctcattcctgtaatcccaacactttgggaggccaaggcaggcagacggtttgagctcaggagttcaaaaccagccctaggcaacatagcaagactccacctctacaaaaaattttaaaattagctaggtgtggtggtgcacgcctgtagtcccagctacttgggaggttgatgtgggaggatcacttgagcccaggagcttgaggctacagtgagctgtgttcactccactgcactccagcctaggtgacaaagcaaggccctgtctcaaaaaaaaaaaaaaaaaaaaaccttcctaaccaatccctgcttatatgtctgccacatgccaggccccatgctaagcattctctccatgtgagctacatggatcttcaatacaaactgggaagagggagattccttagtctcattttccaggtgaagaaaccgaggcccaatgagaaatgacttgctctgggtcctgcagagagcaagcggaaatgcatggccagcagaccctcagcactgccacccttgcttccccaaatgaattggcacaactgactctcgggcaatgtaaagaaatgaagaaatactcctctcaccagcaagccttgtacagatgtccccctctgactagaacaccctcccctttcatctgaaacctttcagcgcttatccaggaagccatccctgtacccgtagcctggatcaggagcctgttcgggtccccaggtacccctcttttccccatcatggctgggtctctgcctcacttgcctctcactgtcttggtcattctgggctgtcactggtgtgcctccttcatggacttacgcgatcattttcagtaagctaggtctggagcttagaaaattgtttagttgccaggcgcaatggctcacgcctgtaatcccagcactttgggaggttgaggcaggtggatcactcgaggtcaggagtttgagaccagcctgcccaacatggtgaaaccctatctctactaaaaatacaaaaattagccgggtgtggtggtgcgcacctgtagtcccagctacttgggggactgaggcagcagaatcgcttgaacccaggagacggaggctgcagtgtgtggagatcgtaccactgcactccagcctgggcaacagagtgagaatctgtctcaaaaaacaaaacaaaacaaaacaaaaaaaataaaaacaggttgggcgcggtggctcacgcctgtaatcccagcactttgggaggctgagccgggcggatcacctgcatttaggagtttgagaccagcctggccaacatggtgaaaccccatctctacaaaaaacacaaaaaatcagctgggtgcagtggtgtgcccctgtaatcccagctacttggaaggctgaggcaggagactcacttgaacccaggaggcggaggtcatagaggagccaagatcacgccattgcactccagcctgggcaacgagcaaaactccgcctcaaaaaaaaaaaattaaaaaacagagcttggattgcttcttagtcttctggctaagaatcaagtgtaaaacagcttggccagtgtgccggggtagggtcctgggagcccctggctgtgtcaagagaccccctttgggccaggtgcggtggctcatgcctgtaatcccagcactttgggaggccaaggcaggcggatcacttgacgtcaggagttcaagactagcctggccaacatggtgaaactctgtctctaccaaaaatacaaaaattagcccggtgtggtggtgcatgcctgtagtcccagctactcaggaggctgaggcaggagaatcgtttgaacccgggaggtggaggttccagtgagccaagatggtgccactgcactccagcctgggcaacaagagtgaaactccgtctcaaaaaaagaaaaaaaaataggagacccccttttactttccagactgtgggagggaggaagagtgttgtcccaggcagtaactaggggctagattattaacaaactagtattttagtgcctgctacacctgaacagtgcttctggctgaatgttagccctgggaatctgaagatcagagaggtggggcatcctacctgaggatgcacagcctggatcctcattttgccctgatttatccagatctgctgtcctccctgcaccctacagagcagggcaatcacagcagggggccccttcagtgtcctcagacagctgctgtgatttgaataaccaggcaggctgctggatgtcccctggtgactgatttgcctggcaaacagaccctcaacccctgggagacagtccccctggggccttgtttcttcttcctatcctcaaaagctccccaggcccatctccccttgcctggctctgcttggtggtcctagtgcttgtccacccctggaggctggatggttccctccaaaacctgggagaagatgggcaggtccccaggcaggggtaacctgagccagcttagtccactcccagggccagccaggaaatttgcatgaagagaatgaggttcctcagaggcttcccctcctttcccaccagggatagtcatcctggggctgaggtctgacagcaggtggaagcagcccctgtgtgtggagagccttccggagggcatgccccgcgccttcctggtcaggagtcggcgtccacagccccccaactggggccatctgcctgaccagctccggggagatgcctatatcccaggtgggcccctcactgtgcctggaggtaaggggcaggagagacgcagtgtcaccatctggcttttctcctcagactgcagcagcctgggggggccaccggcacaacagtcgtccagtgtcagggatccgtggacagcggtgagtgtgtaactggctagcaaagccagctgtttcgctcctgcctgctctcagccttaatgaagctgacagccccttgctcccccgacccatctgcacacgccctccagcctcgggacctgtccgcccctacttctctgtgttgggaatgcctctcctttcctagtagtgagctctctactgttaggtctcaccccaggcaccagggccggcagccacagggatctcttccagcggggcacaagattcatccccacatgtggatgatccgctttatgtcagaacatgggacaaggcaacaggagtgcgatgggagataagggctttttcagctgtgcatgcattggaggaaggaaagcgccagccggaatgtaatatattcatgaaagcaaggcactgttctaggcatgggctgttatattcagcgggaataagacaaaaatccacaattttatggagcttatattctggttggggctgcatgtatagacaataaaattagtcagcctgtaattccagcactttgggaggccgaggcgggtgaatcacttgaggtcatgagttcgagaccaggctggccaacatgttgaaaccttgtctctactaaaattacaaacattagccagacatggtggcacgtgcctgtaatcccagctcctcaggaggctgaggcaggagaatcagttgaacctaggaggcagggcagaggatgcagtgagccgagtctgcgccactgcactccagcctgggaaacagatctagactccatcccccctcaaaaaaaacaataaaattagaaaaatagaccgggcatagtggctcatgcctgtaatcccagcactttgtgaggccaaggtgggtggattgcttgaggtcaggaatt

SEQ ID NO: 78 - DNA, 8134 bp, Homo sapiens
  misc_feature (1)..(8134): n = a,c,t, or g
gggattccgggccgggccggcctgggcgcaatcaatgcggctttgtctgggacgcccacatcccagaggccattcccgggtcggcaaatcggagcgcggcggggcgcgcgggggtgagataagcggccatgtgatcccacctgggctggaaggggaggggcgccaggtgaggcggcggccggtggggcgcgggcggccacgcggggctcctgcagcatggctgtcagcaggaaggactggtccgcgctgtccaggtgagcgccggagggagccgggagagatggaggttgccatgttgctcaagctggtctcaaactcctgagctcaggcaatccgcgtgtctcagcctcctaaagtgctaggatcataggcatgagcgaccgcgcctggccgatgtacatagttcttaatgagacctttcactggtcttcaagatcccagtgtgtatttcacacagcatgccttggttcacaccagccacgtttcaagcacttctgagctgctagtagccagtgcaggcctagagggcatttggtctcttctcccagccctagaggagcctgcctcgggagggtcctgggtttccccagctgtgctgaccctctcctcccctcccccagccttgcccggcagaggactctggaggatgaggaggaacaggagcgcgagcgcaggcggcggcaccgcaacctgagctccaccacggacgatgaggctcccaggctcagccagaatggagaccggcaggcctctgcttctgagaggtaggtgctcaggtttctatcctgatggatggggatggactggttgcctcagactaagtgcagcatattcagtctgctcaggggagttggggcccaggaaatgaggctgaagggtgtgatgatgaatttccagttccccaccttccccagactcagtcctgccagcttccatcctcttcataacaatgcttgctactatttgtagaccatccatgagccaatactgtgctggacattttatggccatagctcacgtaatccacacaatgtccctggagagagaggtattgttaacccattttacaggtggagtaacagggttgaaaagtacttaggtgacttgctgagtcacgtacctcaagatggcagggccagaatgtccatccagatctgtcaagctcccgcctccttccattatccaggctgccttcttctaaccctgaacctctataatttacttcgttttttttttttttttttgagacgaagtctcgctgtgtcgctaggctggagtgcagtggcgcgatctcagctcactgcaagctccgcctcctaggttcaagcaattcttctgcctcagcctcctgagtagctgggactacaggcacccaccaccacagccagctaatttttgtatttttagtagaaatggggttttaccatgttggccaggatggtctcgatctgttgacctcatgatccacctgccttggcctcccaaagtgctgggaatacaggcatgagccaccgtgcccagctgccttttttttttttgagatggagtcttgctctgtcaccccagctggagtgcagtggcgcaatcttggctcatgcaacctccgcctcccaggttcaagtattttgcctcagcctcccgagtagctgagattaaaggcacctgccaccatgcccggataatttttgtatttttaggagagatggggtttcaccatgttgggcaggctgatcttgaactcctgacctcaggtgatccaccagcctcaacttcccagtgctgggattacaggtgtgagccgctgcaccggcctataatttacttctgaggagaagaaccttggggctagttttgccatctagattttgggattatgaggtgggggaagagcctggggtttactgaatgccacctacatgccaggactgtcctgggcaccctcatgagtctcattttgcttcctaacaagcccagtttgtagatgtgaaaactgaggctccgacagtaagttaacttgcctgaaagcacatggagagcagggtgatgaggaaggaaaataatctccttttgctggagccaggtgctgtgggttatggacaatcctctcatgttacttttgtttctttgggtcccccagaagggagaacaggctgtgatgaccctctcctctcctgtcctcccctcccccagccttgcccggcagcagactctggaggatgtccagagctgggctgcaccagtacctgtggctgtcacctagtcttggctgcacccacaagactgacaggagtgtggaatggtgcatcggaagacttaggttctgctcccagctcccccacgaatcagctgtgtgaccttgacaaaatccctggacatctctagtcttgatctaagatctaaggggcagagactgtgcttattccttttgatgccccaatgccccaagcaggctctggcacatattaaaacagttattcagagtctgttgactacgtctgaacatggagtcgttggacttcataggaatttataagctttttaaaaagcatagtgtgctttgctcagatgataccttggaagtgcaatatatcgagtggataaaggtggtggtgagccggggatccagggcctgacatcctcacctcctccttggtggccctggcagcatctccattgggttaggtatacttagggtatcttccacctctatcctctgattctgtctcccatcttctgattcagactaccgagcgtggaagaagcagaggtgcccaagccactgcccccagcctccaaagatgaggacgaggacatccagagcatcctcagaacacggcaggagcggaggcagaggcggcaggtggtggaggctgcacaggcccccatccaggagaggctggaggcagaggaggggaggaacagcttgagccctgtgcaggccacacagaaacccctagtctccaagaaggaactggaaatcccacctcgccggagactgagtcgggaacagcggggcccctggcccctggaggaggagagcttggtgggcagggagccagaagagaggaagaaaggggttccagaaaagtccccagtcttggagaagtcctccatgccaaagaagacggcacctgaaaagagcctggtctccgataaaacctccatctctgagaaggtgctggcctcagagaagacatctctatcagagaagatagcagtgtcagagaaaagaaacagctcagagaagaagtctgttctagaaaaaaccagtgtctctgagaagtcgctggccccagggatggcactgggctcaggaaggaggctggtgtctgagaaagcttccatctttgagaaggcactggcctcagagaagagcccaactgcagatgctaagccggccccaaagagggccacagcctcagagcagcccctggcgcaggagccgccagcctctgggggaagcccagccaccaccaaggagcagagaggaagggccctccctgggaagaacctgccctctttggcaaagcagggggcttcagaccctccgactgtggcctcccgcctcccacccgtcacactccaggttggcagtgtcccgtccctcccacccttctactctgccacctggctggaactgccggccagtcccacccaggtagtccctggttccctgggtgcctccatcctcctacctgcaggctggccttggaagtctcttctttccctgcctgcttctagccatggtcagagcagggaggctgagatggggcaggctgctggagcttaaagggggcccagctgtggggcagggagcatctggtgccccccaccatatcctcatccagggcctgggctccaggaccccggcagactagtggggagcctcagatccttctagaagctcccctggaaagctctgcctggtgccctggccccaagggactttgtctgtgagccactcccacagcagatgaaggaggcaggagagaaggcacagggctgtctcattctcccctcttcctgcagctcctggggtgagccatggggtttatggctgccccggcttgatgggccctagacctcttatgtgacactccccctgctccatccaggtgaaaatccccagcaaggaggaagaggcagatatgtcctcacccacacagcgaacctacagcagctccctcaaacgctccagccccaggaccatctcctttcgggtgagagccctgggcaccctggtctgcgagccactggagggcaagtggaggaagcccgcatccattacaacataggagccgtaggttaggtaggaaggtcccctggatagagaggagcttttgattcccatgggtggccctgaacaaacaaggttgtattcagcagaggagaacaggttagtaacctggggggtaggtgccagtaagcatgagcagccccacctagtgggcaaggcagggtgtatgaagaccggacaggcagggctggccctggtttgcagggaggtccacacctgcttcatcagttcctggctcacctaggagattgtctaggaggggaggggaggaacagagagcagcaaggctctcctactgctccctgccctgccactctcccaatagtacaaactatgtggattggggaaatctcgtcttgctttgtcctggtgtttattcttggttcttctgttcactgggtcattcactcaatcattgggtatcatgcctctaatgtgtgccaggccctggagaggtggcccaatagcgactggtgcccccacagagctcatgggtagtgggaggcagataggaaacaggtggttacaggtgccctgcgaaggaagtctgaagaaagtcttctgacccatattagtgggtgggaacctgtgtcttccagatacaaacaaggatctttaacgaaggcttgtccacatatttctttggtggggttgacccctggtagaaggggtgggaggtctgaagaggaggaggacatgtcttgagagctgggctcctcactcgagggggccaccgatttcccggggactcccacacaacaatgcctttccttctcatttcagatgaaacccaagaaagaaaactcggaaacaaccctaactcgcaggtggggggcctggaggctctggttctttctatttggccatgtccaggctattttctgagtacctgcacccgccctcctgtgccaggctgtggggtagggcacatgaggggaaggtgcagtccttgcccagggctccagatctggcagggggatgggattaacaggatgaactcaggcgggataagatggaacaaggatggggaaggatcagggagagctgctcagaggaggcagggcttgggtggggctccaaagggggatgagggtttagccttgaggttaggacagggcaaagggggctttctgggagggagaccacgaacagtgtnagggaggggaagcccctgctccagcaggcctggttggggggctatgccagactgtgggggagggaaggggaggcccagatcactagagccttgtatgctgtgccaaggcctatggggtctgagctggaaggacaggatcagatttgaggtaggagcagccatgtggagagctcacggtggcaggctgggagagcaggtaagtggcgattgctgtgatggggaagacggaaaggaaggacctgctttgggaggtgttttgcagtggaaatgacaaggtatgggggagaagggatgtcctattgaatgggacgttncttggaagnggagggaaatccctggcgtctgtaagttcctcatgttggccaagtcaacacagcctgcngtgtgatggagggccacattctcttggccacaangagaacgtgtgatggggctgctcctcaggccctgggggcaggcctggtctgccctgggtgtctcacttggctcgcctgttccatcttccatcctgcagtgccagcatgaagctcccagacaacacagtgaagttgggagagaagctggagagataccacacggccatacgggtgggtgggggcttctcctgaggggcggagggtgcaggatgagtagtgggcatggccctttcccctccccagcatgggtcagctgttggtgttcttggttcccagagatcagaatctgtcaagtctcggggtctgccttgcactgagttattcgtggctcctgtgggtgtagccagcaagcgccacctctttgagaaggaactggcgggccagagccgagcagaaccagcctccagccggaaggtgaggggctcaggccccacagggtccttagggtgattagccctgacgtctccaaaacccaaatcttggctgtggcaatgctagaaaactgtcctcatgtgtcaattaatgttggcagaactccatttgagttcccattcacgttcctgagcccatctccttagctgggcacacagctccctgggggaaggggagggggctgtcccaggtatatgtggcatgtgctggatgcataggggagtgagggagagtcctatcccattccagggcctctgaacatgcctcgctgctgcaagggcctaaaccctgagatggaaagttctctttttaggagaacttgaggctctcaggggttgtgacatcaaggctcaacctgtggatcagcaggacccaggaatctggagatcaggacccccaggtatcctcaccctccctgatgtctcttactgtggagcctttgtggtgggatgactggggacagaggagggacagtcggtagaggaggagtcatttcgggagaggaggagtcatttcgggagaggaggagtcatttcaggagtggaggcagtcgggaatagatgggtgtgtgggtcagactctggcagagaggaggggtggtctggttccttttctctttcgggaagagaaaggacatcctgggctgggagctgggcctggggtatcccgagccctttggagcctggtcttagactctggcctccaccctgataccctcaatcaggaggcacagaaagcatcatctgcaaccgagaggactcagtggggacagaaatctgactcctcgctggacgctgaggtgaatggtggggaggagcctggccctacgggggaggccccggtgtactgtgggagaccccatcgtcgccgtgtgcacacactaattggcctgcaatcgcgcagtccacccagaacgcccccatgccctgctcatgcagattggtctgagccaaccgtgagaacaaggttgagccctcacctggttgtgctgcctgcagctctgcagagcccctccctcttcagctggcagattacagggctctgactccttgtgggtgtggggcttgggcaaagggatgccttcctatccagtggcccccttccccttccatgccctgacaccccattgacttgtgctaacagctcttttccccacaggtgtgacaagccccgccaagacagacctgcaagtcttcgtctcaagggacctccctcatgccaggcccctgcctctcacagcagcaccctttcctctcattgtccctgttcccttgttggctgtggatctgtttggccagggtccctggggtcaggaatatttgcaagactcagccagctccttcccagcccagcctcttggggctgggactttctcaccctgcggcaggcacaacagatgctgggacccagtctctgcccaggtcacagcacaagtgcacatcagcactatggggcctatgtcctgcccagagacctctgctccttcctgctcacatccacagtcagggcacggcgcccctcaagaactccagagtcacctgtctcatcggctcccaacaagtgcctctttgtctatgatgtcccccttctctgaggcctggacccacccatctttgtccctgggggctgctcccagccactgaggcccgctctggccaggggagaaggagctgccgtgcgtcttccctgtgccccgtctccctgcttggttctcccctcccttccctggccggctgccatggccaggagctaagtgcctttttgtgtgcaaccacttaccctttctctgaaaaacctgttctcaggaaggatctgataaactcatttactctc

SEQ ID NO: 79 - DNA, 6165 bp, Homo sapiens
  misc_feature (1)..(6165): n = a,c,t, or g
tctagaagattgactcatgcaaaatgcacatcaagttattgtgaggtcctgaaatgatatctggggcttgggcagaggatcgttatagagtttgccctaccactcaaatgctttgggaggtatgcttcctttacacctctcaaatgtgcttctggtcttctggcttaggaagtcaaaatttaaacctagtcctctatggaaaaatgggctcctgtaacatcctgcagaattattaaaataaaacaaggacctagatggataactttcatttgcactcactcagctccaaatcagcatgatccccaaagtctcttgcagctcagaaattccatgaagctagcttacttttcctaacaagaaaatccccttctagaaatgcccatccgctatttgtaaactttcttagtaaactgataaatagatcatttgcccttaaaacaaacttttaatttcaactctgaaagacatgcatatatgtccttcagaatcttaccttttaaaatggaaactgcttggaagtggcttttacctggggaatatgacatgcatgtgtctgttatactgccttcctgccaaaataagtgtgtctttaggcacgctctttgcatattctattgctaactacattttgccagacactgcttgtgaatgcagtatgtgtgagaccactgcccagcttcctgtagtgctagtcctacatttccacacagaactcctcacctagccaaattcttgagcgctttgcagtcagcagcactacctgaggctctgcctgagtgtcactttagttgtcttgcagaaagcttcagatgtccttggttctatttaggttgtgcaaatagacatatgaggtttggttctggttagtggttgctagtaccagatcaccttgcttactggtgagttcattcaaacccaaaaagtcacacctgtgtcctgtgcgcgggtgctgcaggcttaggtggagaaaagcagggctagaattggaacccaaagcccagaatggcaggagaggatgtgggggctccacccgatcacctctgggttcaccaagagggtatctaccgcgacgaataccagcgcacgtgggtggccgtcgtggaagaggtaactgtttacattttgcttatttctttgattttgctttcaagtaacttggtttctattccagtctcaatattctgaagtctttggttttatttttgatcattcctttccattaggagacgagtttcctaagggcacgagtccagcaaattcaggttcccttaggtgacgcagctaggccaagtcaccttcttacctcccagctacctctcatgtggcaactctacccggaggagcgctacatggataacaactctcgcttgtggcagatacagcatcatttaatggtacacatgttgcttaattattttccattgtactgggactctcgtaacagagtactccataaacttttctttttctgacaggtcaggggagtacaggagctgttgcttaagcttttgcctgatgactaacctggtatgtatttctatttctcctctgtcctccccctctttgttttggctctattcagttgtggtgattttaatgatttttttttccaggtgctgggattctacgaagatatgctcctttgttctgttcagtatttggcaatcacttcatccactactgcagtgcacccacccttgggcctggggggagggagtgggttgaaaaactgctcaagaaacagaagtttagcaagggtcatgaagaatactgcaagtgaaactgcagagagaggttacgtaggcagaaagcaagtcaacaaaagcacttagtcaggatccgtaacttgaaattgactcctttggaaattgccatagaacccttaatggacatcatcggctggacctgggatctgatgaatcccacaaaagtcagcaccttctacagaacagatgccctgatcaccaaggacttggtactgatttagagagaagagagcagctcctagcagcatcaacatctatttgtcgcttatttgccctgcagcaattcacctgcctttccttctcccatcctgtaaatatcctaggttttgctccagtgtttcccatcccagtactgacctaatttggatctgctgagtatttagagggctctgaaaagagatatgcattgatgaaattagctacaaaggcttgtgggcctttttttctatctgaaatcgtgtcttcaaattactggaagttgctgatcaaaattgtgggctcttgaattcaatcaactcttttgaatactgtaaaccaacgttaggctagaggagccgacgggcagtggctctatcattcgcagaagaaacccttgataaatgattaaactccttgagctttttttattacgcatatataaatgggaatcatacctacctcaaagcattnnnnnnnnnnaaaaccttacttttaatgtatataaactgttataactactttaactcaggaaattctttacaagatgtaaatgttttcctaggaatcagcaatatttggtgttattacttcctgagaaaggtgccagttaagcagctaaaatggtttttcttgaagttctatagaaaccacgttatttaaaatatctgtaatcagagaatgaattcaaggttttttttccatgtaaagctatttatatcttccaagcctaatgaaatggatattataaaaatacagttgattcatcctatgtttgggaagagtatttttagtgtaattattttccagcaattgtaagggcatatagtgcttgtctcagaagaaaattccacgtagaggggctttaaagtctttatggaaaaaagaaaaataaaaatcatttttcttgttttagttttctggatatgccgcagaaggatccgtgccagaagcaagcctgtgagatacagaaatgtttacaaggtagtatattgtaaaatgctttaaaaatatttttccactgtgaactaactataagagaccaattattcttttatctgtattaactcttttttaagaatgtaacgtatatgtaattatcctgaagattctcttcattgtatcaaagatgcagaaaataaaaagtaatgtgatcaaagctaaaaatttcactccaggtgattagcatcacctggagatctttaaacacttacctagaacaattcagacttcctagggctagggctagaaaaaaagggttttttgttgttgttgtttgtttttactaaaaggctagttttaaattggttatacttcactgcagctgacataacactttttaaaagcaatctggaagaggtgcggttgaaataacaattggaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaattatatattaaaatagctttcttccactttgcaaatcatactttcccctaacgaacctgtcgacaggtctctaaattagaaagaattcagtggactttggtatatcttctttcttccagttccataggtactgaaagtgaaaaggggtgggaagcactgatctaaacctccctgtaccttagtcctatgagatcatgactagagtctgcctgtatgtttttcagccaacagctacatggaatcaaagtgtcaggctgtcatccaagaactgcgtaagtgttgtgctcagtatcccaagggaagatctgtcgtctgttcaggatttgaaaaagaagaggaagaaaacctaacacggaagtctgcatcaaagtaaagttcttctgaagtgctgctccatgtttccaccaaatgaattttttttatcctcctgactcttcaggccaggtagcagcaaatagcaaatgaaaaagtcagctacaaaagttaatgaatatgccatctatgcagaacaggcagaaatataaacacattaaaagacaaatatgtagaatgtaatatactgagctgctaaaataaacctgtttaagagaaaaatttgggttttgtactaaatgtattttaagactattagatatagggtattaatgaattctcttgaagttcaagccactagtgccattcatcaaatttaagtcatatgaggtatgttaggtgaaaggactcacttccagcatcacaattttgacgcctttttttttttttttttttttttttgagatggagtctcactctgtcatccaggc

SEQ ID NO: 80 - DNA, 53522 bp, Homo sapiens
tgtaaactttttgagacagcatctcaccctgttccccaggctggagtgcagtggtgtgatcatggctcactgcagcgtcaacctcctgggtctacttgatctgtaaacttcgagggaaggtgtaataaaccctcctgcaatgtctttgtttttcaaaatctttgtatttcacagtttagcttcgtgggttgatgttctattttgtttttgtgtgtgtgtgtgtgtgttttgtgtttttttttgagacacagtcttgctcttgttgcccaggctggagtgcaatggtgtgatcttggctcactgcaacttccacctcttgggttcaagagattctcctgcctcagccttccgagtagctaggattacaggcgccgccaccacaccccgctaattttgtatttttagtagagatggggtttctccatattggtcaggctggtctcaaactcccgacctcaggtgatccgcccacctcagcctcccaaaatgctgggattacaggcgtgagtcaccgcacctggccaatgttctatttttgagaacacaacagttcataatatattctacatagaccatacctgttatgtgtagataaacagactcttttcccatttaacaccttttgccttaggtttatttttctggtatcaatactggcacacttactttgtttgcagtttcctgtcttttttttttttttttttttttttgagacagagtctcactctgtcacccaggctggagtgaagtggcgggatctcggctcactgcaacctctacctcctgggttcatgcgattctcctgcctcagcttcccgaatagctgagaccacaactgtgtgccaccatgcccagccaatttttgtatttttagtagacacggggtttcaccatactggccaggatggctcaatctcttgacctcgtgatccacctgcctccgcctcccaaagtgctgggattacaggcatgagccactgtgcctggcctttttttttctttttgagatggagtctcactctgtcacccaggctggagtgcagtggggtaacctcaggtcactgcgacctccgcctcccgggttccagtgattctcctgcctcagcctcccgagtagctgggattacaggcacccaccaccatgcctggctaatttttgtatttttagtagagacggggttttgccacgttggccaggttggtctcgaactcttggcctcatgtgacccgcctgccttggcctcccaaagtgctgggattacaggtgtgagccactgtgcctggcctggctttcttgtttcttttctcctcttctagtttcccccttttaggctaacaattattcactgttaataaaaaccctcaggtctgtattttatcaagaaacatttccctcacgtcttcttccctgaaccaaacaagatctctggcacattttatttgctctgtctcaccacatggattttgtttttttgtttctttgttttttgagatggagtctcactcttgttgcccaggctggagtgccatggcacaatctcagctcactgcaacctccacctcctgggttcaagcgattctcctgtctcagcctcctgagtagctgggattacaggcgcgtggcaccacccccagctaatttttgtatttttagtagagacggggtttcaccatgttggtcaggctggtctcgaactcctgaccttgtgatctgcccaccttggcctcccaaagtgctgggattacaggcatgagccaccacgcccggcccccatggtttttcaaatagtttagaatttcatttccaggtaactaatttgcttctttaaacatatgtcttttctatttaagaaatcctttctaaacaattgcattttattccacaaccgccttcaaacaatcattgagacttggttaatctgttttgctcatttggcagcagtttcttgtggctgtttcttccctccactggagtccttgaatcttaagtctgtcatttgactgcaattaaaagctgggtttggaatacaatcgcagccttaccatccacctgctgtgtgacctggtaaatttctttttttttttttgagacggagtcttgctctgttgcccaggctggagtgcagtggcacaacctctgcctcccaggttcaagcgattctactgcctcaggctccctagtagctgggattataggtgcctgccaccatgcccagctgatttttgtatttttagtagagatgaggtttcaccatgttggctaggctggtctcgaacttctgatcttgtgatctgcccgcctcggcctcccaaagtgctgggattacaggcatgagccaccactcccagccagttctttttttcttttttccatttttttttttttcgagacaggatcttactcttttgcccaggcgggagtgcagtggcacaatcacggctcagcgcagccactgcctactgggctcacacgctcctccggcctcagcctctcgagtacctgggactacaagcgtgagccagtttggctaattttggctaatttttgtagaaacggggtctcgccatgttggccaggctggtctccaactcctggactcaagggatccaccttcctccccctctcaaagttctgggattaccggagtgagccactgtgccctgctggcaaatttcttaaactgtctgtgcctcagtgacctcatttaataaagggaataattgtagcacactttttctagagctgtgaagattcaatggaataaataaggcaataaatgaatggatggggaatgaaggatgtgggtttcctccctcttgtctttcaataagctctcaccatcaacctcccattgcctgttctctctcttccccctctctccctctgtctctctctcagccaggaaacctggggtagggaggcttggagccagcgggtgcgtcgggaggctgcgggtactgactcgggccgcgcacggagatcgcgggagaaggatccacaaccgcggaagaaggatcagggtggagcctgtggctgctgcaggaggaggaacccgccgcctggcccacaccacaggagaagggcggagcagatggcaccctgcccaccgcttcccgcccacgcactttagcctgcagcggggcggagcgtgaaaaatagctcgtgctcctcggccgactctgcagtgcgacggcggtgcttccagacgctccgccccacgtcgcatgcgccccgggaacgcgtggggcggagcttccggaggccccgccctgctgccgaccctgtggagcggagggtgaagcctccggatgccagtccctcatcgctggcccggtcgcgctgtggcgaagggggcggagcctgcacccgccccgccccccctcgccccgtccgccccgcgccgcgcggggaggaggaggaggagccgcggcggggcccgcactgcagcgccagcgtccgagcgggcggccgagctcccggagcggcctggccccgagccccgagcgggcgtcgctcagcagcaggtcgcggccgcagccccatccagcccgcgcccgccatgccgtccgcgggccccgcctgagctgcggcctccgcgcgcgggcgggcctggggacggcggggccatgcgcgcgctgccctaacgatgccgcccgccgcgcccgcccgcctggcgctggccctgggcctgggcctgtggctcggggcgctggcggggggccccgggcgcggctgcgggccctgcgagcccccctgcctctgcggcccagcgcccggcgccgcctgccgcgtcaactgctcgggccgcgggctgcggacgctcggtcccgcgctgcgcatccccgcggacgccacagcgctgtgagtagcgggcccagcggcacccgggagaggccgcgggacgggcgggcgtgggcgggttccctggcccgggacgggaagcaggacgcgggccaggacgctcccaggggcgaggctccggcgcggcacggcgggccctgctaaataaggaacgcctggagccgcggttggcacggccccggggagccgaaaaaccccgggtctggagacagacgtcccacccgggggctctgcagacgccagcgggggcggggcgcggaggccgcgctcagctgggaggacaaacagtcgctaattggagaggaattgggatgcggcctggggctgcggggtacccggagaggtggggatggctgtagggggcggcagggaagagttccaggaggtgtctggaaaaggatttgatggatgtgcaagaattgggctgatgcttaggaaggggcgatgaggtgggtccagaagaaggggggtgaacggtgtgagcaaagaccgtgaggctggaggctggccacgggaggtgtgaggggtaggggcagggtgggaggtgggctcgcgggtgggctggggtcatgaagggcctcaggcgctctgctattgggttccaaggctatcctgagaacaggggtgaggggggattgccgtggggggttaaagccttgtcatgttcgctttcgggagataaaaacaacaggtggcctttatggagacgctgcccagagccaggtctgtgccaggctcctgttgggggtcgtcatgcggaatcctgactctgaccatccgaggcatagggaccgtggagatttgcatttcacagatgaggaaacaggtttggagaggtgacacgacctgtcccaggcatcacagccgggatgtgcatagcaggggtttggaactatgaggtgcccaggacccagggttggattgaaaagggcggaggggactaagataagcagacagttgtccccagcgctggggagagtcttgggaccagtctgatgccttgtatttcccaggctccaggctcctcgccgggacagtgtctccttgggtgcgtgctggatccctgggggacgtggcacatccccaggcttgctaaacattgggtgggttctggcatttggttttgtaacgtttctgggtcactcccgcctgtggccacccttccttaggggagccgtgtgtccttggggctttgctgggtggtctcgagggtgggagaagaatgggttctcctggaccaatggagcccgtgcccctcggggccacattgctcctgcgctccctgactgcggacgcgtgtgtctcgcggctgtctctgtggagatggcctcctcctgcctggcaacagcacccacagaattgcatcagacctaccccacccgttgtttgtgatgctgtagctgagggctcctctgtctgccaggccggtcactggggactctgtccagggcctggtggttcctgcttcccagcacctgatggtgtccatgagagcagcccctcaggagctgtccgggagagaagggcgctggtggctgctgagcggagagcaaggcccgtgttctccaggcccttggcacagcagtggagcccccgcccctgccttgtgttgtcctcttaggctctggtcctggggtttggaggagggggaccctgggagttggtggcctgtcccagcctgagctggcaagattccgaatgccaggccccccaagtgtgcaacagggcacagggtgacctcatgtgggcaggtgggtgctgttctgtacacacctggggccgccgctgggagagttctggaaggtggggtgaggggacccatggcaaactagggccttaggaaggatgtgaaggccctggctggccccccaggccaccctctgtgctgtggggcagcccagccattttgctgtctaccctgcaaactcctcctcggggagacggctgggttttccccagggaagaggggtcaagctgggagaggtgaaggacacagatcacagctgctggcaggtgttcaagggtccaagagcgttgctgtctgggtgtcaccagtagccttcctggggggctcacgcaggtgcctctccacttgtggctccctggctgctgaagctcagcagggacagctgtgtccagttccaggtggaggacagccggggcttctgaggccacagcctgccttgggttaatgatgctgccgagaggtggtggcttttggaaaagatggcgtactgcaaaacgtgctgctctgcgtggctcgaagcttcgtggggagacgtgggcagagccgtggctgactcacagaccccccaccccagagcctgccctgccctccctgccccgacccttctccctcctgacccatgtgttttttttttttttttttttttttgagacagagttcactcttgttgccaaggctggagtgcaatggcacgatctcggctcatggcaacctccgcctcctgggttcaagcgctttttcctgcctcagcctcccgagtagctgggattacaggcgtgcaccaccatgcctggctaattttgtatttttagtagagacagggtttctccatattggtcaggctggtcttgaactcctgacctcagatgatccgcccgcctcggcctcccaaagtgctgggattacaggcatgagccaccacgcccagccctgacccatgttttgaaccaaattccagccacccttttatctgcaagcattttggagggcatcgcaatactgcagacccacctaacacaacagacagttccttcatgccaccgaaggcctggtgtgttcacatttttggtttaatagtttgaattaagagccaaataaggtccacacactgcaattagttgatgtctttttttttttctttttttttttttttttgagacggagtcttgctcttgtctccaggccgcagtgcagtggcatgatctcagctcaccgcaacctccgactccctggttcaagcgattctcctgcctcagcctcccgagtacctggtagctgggtttacaggcatgcaccaccgtgcccagctaatttttgtatttttagtagagacggggttttactgtgttggccaggatggtctcgatctcctgacctcgtgatctgcccacctcggcctcccaaagtgctgggattacaggcgtgagccaccgcacccggccaatgtcttttaaaaatatatactttttttttttttttgagacggagtttcgctcttgttgcccaggctggagtgcagtggcgcgatctcacctcacggcaacctccgcctcccgggttcaagtgattctcctgcctcagcctctccagtagctgggattacaggcatgtgccaccatgcctggctaattttgtatttttaggagagacggggtttctccacgttggtcaggctggtctcaaactcctgacctcaggtgatccgcctgccttggcctcccaaagtgttgggattacaggtgtgagccaacgcgcccagacaaaaatatatgtgtgtctttaaggctggtcaagcaaagcagtaggactggagaaagaatgaagaattctacctggctgtgatcaattcgttgtgaacaccactgtgcttggaccagctagctgatgtcttttgttttgttttgtttgagacggagtctggctctgtcacccaggctggaggacaatggtgtgatctcggctcactgcagcctccatctcccgggttcaagcgattctcctgcctcagcctcctgagtagctgggattagaggcgcgcgccaccacgcccggctaatttttaaaaatatttttagtagagatggggtttcaccatgttggtcaggctggtcttgaactcttggccttaggtgatctgcttgcctcggcctcccaaagtgctgggattacaggtgtgagtgatgtattttatttatttatttatttatttatttttattatttgagatggagtctcactctgttgcccaggctggagtgcagcagtgccatctcagctcactgcaagctccgcctcctgggttcacgccattctcctgcctcagcctcctgagtagcctggactggtgcccgccaccatgcccagctaattttttgtatttttagtagagacggggtttcaccgtgttagccaggatggtctggatctcctgacctcgtgatcctcccgcctcagcctcccaaagtgctgggattacaggcttgagccaccgcctgtcttttaaatgtccgatgatgtctaggagcttcccttcctctctttttccttgtgcaatttgttgaagaaactggctcctgcagcctggatttctcgctgtgtcttgggggtgccacctccatggtgtcacctccgtggtgctgtgagtgtgtgctttgtgtttcttgtaaattggtcgttggagccgacatcccattgtcccagaggttgtcctggctggcactggcctaggtgtagatgtcatcagctcagggccccctgctctaaaggccacttctggtgctggttgccactcaccctggctgggggtcacctgggtctgctgctgtctcgcaaatgctggggtccaggactgggcacatcgagggacttggtaggtgcttggttcactgatgtaaaatataggagcacccggggccttgccctttcccacctgcatccctgaatgacaggagagtgtgggagagtgtagggacagcaggcgcagaccccggggcccctgcctgggattggcgtcggggaagacaggcattctggagcgacccctaggcctgatgccttagagcgcaactgccagagacacagcttccttggggggctggccaggccacggaggggccctggctcccatttctggtccctggatcctgagagcgaggactagggattgtcaccaaggcctccatgagccctcagcagaaggagggccaccctcgagggctccgttatcactggagcccgcgttcaaccaacacgcagatgattctccaaggacagagatggatgatggggagggggctggcctggaaggacccccagtgcaggtgacattgaagccaggtttcaaagctcccacagggagctgcccagagagagtccccaaggggcaaggtgactcgggggcaggggtagggcctctgtcaggagagcctaggagaggcctgtgtcttctaggaagagccctggcagccgagcggaggcagtggtgaggacctgcatcctgcatgtccagctggcctcacccggggtccctgagccgggtcttacgtggctcccgcactcgggcgttcagaacgtgcctgcgtgagaaacggtagtttctttattagacgcggatgcaaactcgccaaacttgtggacaaaaatgtggacaagaagtcacacgctcactcctgtacgcgattgccggcaggggtgggggaagggatggggaggctttggttgtgtctgcagcagttgggaatgtggggcacccgagctcccactgcagaggcgactgtggagacagagagcacctgcaggtcatccatgcagtatcggcttgcatccagatcatacagggaacactatgattcaacaacagacagggaccccgtttaaacatggacaaggggtcactcacgcctggaatcccagcagtttgggaggccagggtgggtggatcgcttgagcccaggagtttgacaccagcctgggcaacagggtgagaccccggtctctaaaaaataaaagaacattggccgggcgtggtggtatgcatctgtggtcccagctattcaggagactgaggtgggacatcacttgagccgaggaggtcaaggctgcagtgagctgtgatcacaccactgcactccaggctgggtcacagagcaagaccctgtctcaaaaaaaaaaaaaaaaaaaaaaaaaaatcacaggatctgaacagagatttctccaaagaagacgcacagatggccaacagcgtgtgagaagatggtcggcctcattagtcatgagggaaacgtaaatcaaaaccactgtccagccgggcgcggtgcctcacgcctgtaatcccagcactttaggagagcagatggcttgaggccaggagtttgaggccagcctgggcaacatagcgagaccaataaatagatattagtggtggcgcctgtagtcccagctagttgggaggctgaggggggaggattccctgagtctatgaggttgagactgcagttagctgtgatggtgccactgcactccagcctgggcgactaggaaacggtctttaaaaaaaaaaaaaaaaaacagggtgggcgcggtggttcacgcctgtaatctcagcactttgggaggccaaggtggggggatcacaaggtcaggagtttgtgaccagcctgaccaacatggtgaaaccccgttctactaaaaatacaaaaattagcgaggtgtggtcgtgggcgcctgtaatcccagctaattaggaggctgaggcaggagaatcacttgaacccgggaggcggaggttgcagtgagccaatatcacaccactgcactctagcctggtcaacagagcgagactctgtctcaaaaaaaaaaaatgctgagcgtggtggcgcatgcctgtagtctcagctactttgggggctgaggcaggagaatcgcttgaacctgggaggcagaggtcgcagtgaggcaagattgcaccattgcactccagcctgggagacagagtgaaactctgtctcaaaaagaaaaggtctaggaagagtccgcaccctctccccgcggtggccacgccgggctccgcgctgagccctctgtgttcttgtctctccatacctcatcacggcaccgcagggttgcagccactcctggtctcattttacacaccaggaaattgaggctctttgagaagccgtggtgatgatttcatcagcatgctctggggcagacccctgcagccgcacagggtgcctggggcccacactagtgccctggtttatagacagacagaggtggcagtggcgcttccgagtcgggctgcgatgtgcttgcactccccgaggggctgaggggccctgcgcccaggtgcagctgcttgggtgctgccagcccctcccacctctccctccctgccagcccctcccacctctccctccctgccagcccctcccacctctccctccctgccagcccctcccacctctccctccctgccagcccctcccacctctccctccctgccagcccctcccacctctccctccctgccagcccctcccacctctccctccctgccagcccctcccacctctccctccctccagcccctcccacctctccctccctgccagcccctcccacctctccctccctgccagcccctcccacctctccctccctgccagcccctcccacctctccctccctgccagcccctcccacctctccctccctgccagcccctcccacctctccctccctgccagcccctcccacctctccctccctggctcatccctgctgtgtcccttctctctagtttcctgttcagtttcaggaaggaggctgggaacccagatgtagggaatttgcgccctggagtcagacctgggttcacgtcccagcgcctccacctctggtgtgaccttggtccagtctctcagcctcagtttcctcacctgtaaagtgggctccatgattagatgcaccctgcagggcagtgtagcagtgacctggctcagccactggcagccccaacaatcataccttgttaaagtagctctgtcggttccctcaggggttccgggggcccattcccctgtcctccatgcactgtgagacctgccctgccacagagcagagtgtaacagcctgagggtgagagccagacactgtgcctgtgcttagaccagacactggacgacgggagccagtgcagcctgggcgggtggactcctatggacccctcagcacccagcctcggtgccttcagcgcagggccgcgtggctgtgggggctcacaagacccggcccactcctgcttgtgcctacatctgggtgtttgcccattggtgccttttgacgcgttctggtgtgtgtgagacgtgcggggctgggaagtgttggcagagccgcgagtaccgtcctcactccttttgttcttttgacgtaagctggcgagtggcactgcctgagttccgctcagtgcccgccctgatgtgcggaccccgctgcattcttgctgttaggtggtggcggtgtgcgctgtcgctggtgggcaccgagagtctttgggagctttggggaggttgtgccaagcctgagcctcgacgtcccccttcccggctttctgttggctcttctgaggccagggcatctctatgagggcctcctgctggagccgtctctgtggatctcctctgccatcctggcccatgagtgggtgatgcgctggccaccatctggtgacagtggccgggcaccgctgccaaatgtgggtcccgcatctgcaagcccctccctgggtcccctagggtatggggtggttctgccactgccctcgctcccccaccttggggtgcctctccccctgctcgtgggggagaccctgcctgggatctgctttccagcaaggaatatactttggagggagacacacatgttcttttctggagctctgcagtggccacggcagcccagcccgccaagcaccctggaatgaaaacatcccgctgctgtctgggcctggcctgcactctgctgcctgcgctccagctggctgaggccgggcacgtctgcgggcacagcagcgggggcgccacagtctccctgcagagtgagcgcagctggaaaatgcagctcacgccctttcccagaacacctcgctcttcatggcttggcagctgtccttgcctaggggccagggtgcccaggcactggtggcaggagaagggctacatctggggctgaggcgggctgggtccttttctccctgcagctcccgaggcccagccctggcccagcctggcattcctgaccttagcagcgccatgatctgaagacaggctggcttctgtgaggccacctcagaaagggctttgtgcccaggcagaggcggaagccagctcttccttctggttgaggcaggaatgaggccagcgctgggcaagcccatgcccagggaacgtcacagctgtgggagtacaggggctccgggttctgagcccgtccactgtgcatcgtggccctggcctcaggatggctcgtaccatcattggctgtgcccacagccgagtgggtgatgggattccggctgccccgctggatctgtgctgctgccctctccagggcactgctgtgcccgcacagccgggcgcagatggccagtttgcttgcccccccccccaccatcctcttcctaccttggcttcctccattgacacactggaccctgctggctgcccggggaggtgtttgggggatggtgttgggggaggaggagggccccttgagcctcagtgtgcccatcaggagcgtaaggtcagtgcagcacctgcccacacaggctgtgaagggtgggagtggagagggatgcaagggggtcacaacgcctggctccatgtcagctgcgtgcaggggcaccaggagccggccctcattctccccttgaactggaagggtggccccgaccccagcggcaggtagcatacgtatgaagcgctctccttcctacaccccacaggtgggctcgtctccagacggccctttttgagctggctgtgtttttccatctgtgtaggcaaggacatcgcagactcccctttctcatctccctcgttcagcctccgaggccggagtctccatccctgtgcctgcctgtgggtcccgggaggacctgaggctgcccatgtcacccccggcatctcatcctggggacagttcagccgtgggagggatctgtaaggacagaatgccgctgagcctggggctccccagctagtctcacaccccgtgtctgggacccagagaccctcgtgcagggctctgttgcttggggcctggcagcctcgtcctgtatcagaggctgccacccccacccctcgtggggccagggttgtggccggcctccctggccctccccatggaagtggtaggcggagccagcagccatctgcccagcccggggctgcactgttttttttcaaatgagcaccgtcccaaactgcagcccgttaatttaaacaggatcatttccggccctggaagccgcctcactctccttaaatagaaaggagcacagcgcagagggaaacagatgaggtcatggctcggctggcccagcgaggaaggggccgcagtgggggtggcactgccgcctgtcccctgtcctctccagcgcccacactgcagcccatttcctcaccctgggcctgctctcgggagggacgggcctgggggtcctcttgctgggcggaggggaaccagctcctccaggagaggacggggcctggcagggggcatggggcctccctgggtctggcgtcctgtcctgcccctgccgagggaggagcggttacataagctccgcaggcggcccctccgagccggtccccccagcccagtttccagtgaggcggccagcgcgggcgggggtgccgggcctggcgcacacccgctgctgaccacacgtgtctggaatgtgcagatgtttctttgggggctccgtccggcccccagaccccactcagcatctggtctggggagtgggcgcctggggcactcagctctgagtgtgagactctgaggcaggtctggtttgtctggggccattccctctgctgtggattgggagggccccgggagctgccccacacccagggaagttctcctcagtcccactgttgcattccccgaccccggctcccccggcccaggagcgcctgtggggcagaaggcccagccccaagacttcccggccctgccagcctcaggcttcacccaccctcgcgccaactgtgggcagagcccagggggagggcaggagagccagcgcctggctgggaacacccctgaggggccgaggctccagggcgagggggcccgacctggggttcacacgcccgggtggcgggcagacccgctgcagcatgagacacgtgtcagctacctcgggccggcaggctggccctgctgcccacagccctgggacgtggccccacctgtgacgggtgtggaggggcagcctccaggcctggccacaccctctgctgttgctgctcctgctccaggattggcaagggtgctgggaaggggtgaagacccgtactgtggccacacacctgggacttccttctccacccagtggtgccccagcagccgctaaggagcccgctgggtcccacgctaggatggtcctaactcctcccgccttccagatcggacgctcggcgctggggaccccttgtgtcccggggctggggcaccgtcctgcccccatgggggtgtactcctcccgacaagcttggcttcagcttccctgggagcacatcctggccctcgggcacccatcaggctgtccctgtgcacctggctcccacccttccagctcatagcaggaactggggtgaggagtgcgtggggcagcaagggcctgggaccccagaggaccctgcactctgctctgtgctcttgcctgggcttagggccgctcggtggtcctgctgccagatgcctgggccctgctgtgtcccccatccttgcagggaaccagaacgtgggggcagggcatcagacagcggcgatgatgtcacctggcgggtgcagaggaagcccgaggggcggggtgggggggctggcgcgaggctgcctggctaggccttggcgttcccccagaacggcgatggcaaaagcagatggagacgtgaaaaagtacgggagcaagcgaggtgaggactccacggggacccctgtgctgttccctgtccctgaagcccacacctgagtcctgcccagggcagatgcttccacacccagggggcacctgagtcctacccagggcagacgcttccacaccctgggggctgggggactgcacctggctcctgtctgggccccagcttcattccactgccctgggccctgggagctcggccgagcggggtccccaagaccttgctgcatttctgggccttgggctggggtgagggccgggagaaggagccagcctggagcctggcacgcagggagtgcatggccagaaccggtgacaggcagggctgcctgctggcgtggaagaagtgtccatggcacccccaggcctggttcacagtgggatgggcggggagccggggggctctggggtcctcggctgacctgcccccacccctgccctggcttgtcagctcccagcagcagccactcttgatggattttccagaaaatgaggtgtggccaaacatcttcaggcttttccttctttcctttctcccgtggcctgggtgggagctgctccccatgcctgggggcaggtgcgagagcctgtgcccctccctggggcagtttcacagctgtgtcccttccagggggcctgcctgtgttcaccgtggcctctgcagcacctctcgccccttagggctcctgcgcctcgggtcccggtgcctcatttctccctaaagcattggttctgctgccgccgcagccgctggaaagtccctcctcaggtctaactgcagttcctcacggcacagtgttccccctcgggcatggtgcttgggcagtgggtgtgagtccagctgcctcaccctgtctcgagaatggcctcttgctggtctcccagccaccaccctgtcccaccccacggcggggatggtgtggatgcctagcagcgcggctgtgggcccacccatccttatgggcagtggggagcacctcagcccgtgtccctaccttggtgtagaggaggggacggcagagaagcagggttcagttaggggggaagtggtggccctgccggaggggccgttccctgtgtgcctggcccccagatcctctcccctcccggagcccagggcacaggcataggctctctgagtgtcccacagcccctgggggaagggaactgcacccccaaccgtgccctccatccgcagatggaacgagaagctccgggagccagtgcccagcgtctcatctgtctgggcacccagcccaggtgagggcctggctccaccgtccgtggctggtgctgcttcctggcacggagaaggcctcggctgctctgtcccctcagctggggtggcctctggtccccttctttgttggttcccttctcaagctcttgccctggccccgggccccaccgggcagcctgtgtgtgcgtctctcctgcgccgggtaggctcctgtgggagcggagctccggtgggaggagcagggctggaggctggcaggggctgggcgggtgttcagggatggaggccgccccggcttggggctggctgccgggtggtcattgctgggaagagcaagtctaggcggaggcacctgctgggtcactcgtggggagggtgacacctggggaagtagaggcccgtggcaggaggtgaggcctcggggtcctggggagcaggggggtggtgtgcagacctgcggagccatagtcctgtgccaggagcactactgggagtgcgtgggaccaggaggggtgcccagggtgggcggcagagtgacccccgaggtgcttgaggccgaggggaggtggagttctcggtttgccccagctctctgtctactcacctccgcatcaccagctccaggacctggtttgtaactcgggcagctctgaaaagagagacatgctgccgccctgtggtttctgttgctttttcttcactgactactgacatgggatgtttttcctacggctgtgaccaattgtgcttcttctaattgcctggtttttctttttttgtttttggagttttctctttctttcctccctccctctcaccctccatcctttttttttttatttttattttttgagatggagcttcactcttgcaggatggggtgctggagtgcaggggtgcgatctcagctcactgcaacctctgcctcgcgggttcaagtgattctcctgcctaagcctcctgagtagctggaattacaggtgcttgccaccacgcccgactaattctgtagttttggtagagacagggtgtctccgtgttggtcggtctggtcttgaactcctgacctcaggtgatgcgcccgcctcagcctcccaaagtgctgggattacaggcaggagccattgcacccggctctttccccttctccttttcttctctctctcctccctttctttcttttcttttcttttttttttcttttgagatggagtctcgctctgtcaccaggctggattgcagtggcgtgatcttggctcactgcaaccttcgcctcccgggttcacgtgattctcctgcctcagcctcctgagtggctggcactacaggctcccgccgccatgcccggctaatttttgcatttttagtagagacagggtttcaccctgttggccaggatggtctcgatctcttgatctcatgatccacccaccttggcctcccaaagttctggcattacaggagtgagccaccgtgcccggccatctttctttccttgctttctctttgttttctttcgagaccgggtcttgctctgtcgcccaggctggactgcagtggcacaatcatagctcactgcagcctcgacttccctggctcaagcgatccttcctcctcagccccccgagtagctggaactacagttacacactaccatgcctggctgattctttttttccttgtagagatggggtcttgctatgctgtccatcctggtctcaaactcctggccttcccaaagcactgggtttacaggcataagccaccacacccagtttccttttcttctttttaactggaatagttgacgttttctttattagctgtgtgtcaggagggtatttttggcctttagtatgtcgtgtaagttgctagtgcttttctgagattgtagtttgttttctaattttatttatattttgcgtagaagttgtgtattttagatggagttaggtcggctggtctttgatgttttatttattaattatgtatgtatttatttatttttgaggtagagtctcgccgtttcacccaggctggagtacagtgatgcgatctcagctccctgtagccttgacctctctgggctcaagtgatttttctctcctctacctcccgagtacttgggaccccaggcgcatgccgccatgcctggctaatgtgtattttttgtagatacggggtctcactgtgttgcccagggtggtttcaaaatcctgggcccaggcgatccttccgtctcagctcccacggtgctgtgttaccggcgtgtgcccagtgcctggccgtcttggaggtcttgtttctctgggtttatgcctcgaggtggcgcctgctcccctgtgctccctggtagcctggtagtgagcctgcttctcacacagtcatacctggttgtggtcccacagtgggaccaccctgttgggttcagaacaggagatgggggcccctcgagtctgtgtgggggctgtggacagggttgggagaccttggctctgtgggggactgtggacaggggatggggggccttggccctgcgtgggatgggttgggggtccgtgcccttcctggccctgggtggacaggtccatgtggcactcggcatagggctgagatgggtgcagagggctgaggcccccaggcctctcctggcttggtttccccagatgagtgttcatttgggtcttccatcagaaagtcccctcctgacctctgggagtggggagctcaagggtgggaggccatagcttggggatgctggcaatgtgtgggatgggcccagggaaggcctctggcctactaggggctctggccctgacccacggccactcactcctcagagacgtctcccacaacctgctccgggcgctggacgttgggctcctggcgaacctctcggcgctggcagagctgtgagtgtcccccagtcgtgccagcatgcggggctcactccgggtgggctggcggcaccgcctcttgctgctcagctgtgggggcttccatcagctttgccgaatcccccgtctcttccagggatataagcaacaacaagatttctacgttagaagaaggaatatttgctaatttatttaatttaagtgaaatgtaagttgtggttctttgggtggggtcctggctggaccccaggcccccaatatcccttctgccctcccagttggtccgtgtccccttccaggcttgagaccagatcctgggggcagttcactgcctgcttggagccccccagtgccggcttggttggggcaggggaggcggtgctgtcagggtggctccagggcctggttgccagtggggggctggcatagacccttcccaccagacctggtccccaacacctgcccctgccctgcagaaacctgagtgggaacccgtttgagtgtgactgtggcctggcgtggctgccgcgatgggcggaggagcagcaggtgcgggtggtgcagcccgaggcagccacgtgtgctgggcctggctccctggctggccagcctctgcttggcatccccttgctggacagtggctgtggtgagtgccggtgggtggggccagctctgtccttcccagccaggtgggacctgggccctgcagacactgggcagggctcaggaaggcctctctggggggggcctccgggccaagggaacagcatgggagcctgtgagtgcggcgggcggatgtgggggcgtggggtggagccaggaggagcagaacccggggtccagtggctgcctcttctaggtgaggagtatgtcgcctgcctccctgacaacagctcaggcaccgtggcagcagtgtccttttcagctgcccacgaaggcctgcttcagccagaggcctgcagcgccttctgcttctccaccggccagggcctcgcagccctctcggagcagggctggtgcctgtgtggggcggcccagccctccagtgcctcctttgcctgcctgtccctctgctccggccccccgccacctcctgcccccacctgtaggggccccaccctcctccagcacgtcttccctgcctccccaggggccaccctggtggggccccacggacctctggcctctggccagctagcagccttccacatcgctgccccgctccctgtcactgccacacgctgggacttcggagacggctccgccgaggtggatgccgctgggccggctgcctcgcatcgctatgtgctgcctgggcgctatcacgtgacggccgtgctggccctgggggccggctcagccctgctggggacagacgtgcaggtggaagcggcacctgccgccctggagctcgtgtgcccgtcctcggtgcagagtgacgagagcctcgacctcagcatccagaaccgcggtggttcaggcctggaggccgcctacagcatcgtggccctgggcgaggagccggcccgaggtgagtgtctgctgcccactccccttcctccccagggccatccagatggggcagagcctggtacccccgtcttgggcccacactgaccgttgacaccctcgttcccaccggtctccagcggtgcacccgctctgcccctcggacacggagatcttccctggcaacgggcactgctaccgcctggtggtggagaaggcggcctggctgcaggcgcaggagcagtgtcaggcctgggccggggccgccctggcaatggtggacagtcccgccgtgcagcgcttcctggtctcccgggtcaccaggtgcctgcccccaccccccgaggggccataggttgggagatctctgaagcactggggcagagactgcggctggggagtctcaggaggaaggaggtgggagctgggccggccctggtgagcaggtggcgccggccggtggggccgttcctgtcagctctgcagatgcagaggtggacatgagctgggggcagcctccggacactcctgggcacgccatacgggaggtggcctgcacggggatccctgccggtacccacaggccccgtgggtgggtgctgctgtgagcctgggctggtgggccctggtctccgggctctgagcctcagtttccccatctggaaagggggacagtgatggggctcccagcgggctgctgtgagggtgggaggatggaggagtgccctgagccccctgccatcccacacccgcccccaggagcctagacgtgtggatcggcttctcgactgtgcagggggtggaggtgggcccagcgccgcagggcgaggccttcagcctggagagctgccagaactggctgcccggggagccacacccagccacagccgagcactgcgtccggctcgggcccaccgggtggtgtaacaccgacctgtgctcagcgccgcacagctacgtctgcgagctgcagcccggaggtgtgcggggggccaggcaggggcctgagacgctggctgtggttaggggcctgccgagcgcccgcggtggagcctgggctgaggaggaggggctggtgggggggttttcgggcggctcggtccccagtctgttcgtcctggtgtcctgggccctggcccggcgcctcactgtgcactcgccaccccaggcccagtgcaggatgccgagaacctcctcgtgggagcgcccagtggggacctgcagggacccctgacgcctctggcacagcaggacggcctctcagccccgcacgagcccgtggaggtagtcggccccccacgttctacaacctgccctcctgcctgcccctggaggccttgcctgccctgcccactgtgggtctcgccaaaaaacttgggggccttaatgttgcttgtgcccagtgaagatggttgggaaaatccagagtgcagagaggaaagcgtttactcacattacctccaggccttttctctgagcgtgtgtgagttattcctgaaaggcaggtcaggggtcctgccccccatggacagtttccaccggagtcttcctctcgagcgacaggagccaggcctgtgggggtctgatggctcgctctccttccctcccctcttcctgggaagttcgggtagggggagtctgggcttcaggctgggatggggtctgtggagctgaggcggccccctgcccaccaggtcatggtattcccgggcctgcgtctgagccgtgaagccttcctcaccacggccgaatttgggacccaggagctccggcggcccgcccagctgcggctgcaggtgtaccggctcctcagcacagcaggtgggactctgggtggtgggtggtgggtggtgggcgccgcaggactcggggtggcctctctgagctttcacgtctgctggtcctgtggccaccagagtggttcccagtcttaggtggacagagcaggggttccagagacaccagctcattccaggtgtcctgggggtggattgggtggggcctgcctgggggccggcctgggtcagtcggctggccggagacggacgcagcactgggctgggagtgctgcccaggtggggagacctgtcctcacagcaaggccaggattgctggtgcaggcagttgggcatctctgacggtggcctgtgggcaaatcagggccccaacaccctcccctcctcacagggaccccggagaacggcagcgagcctgagagcaggtccccggacaacaggacccagctggcccccgcgtgcatgccagggggacgctggtgccctggagccaacatctgcttgccgctggacgcctcctgccacccccaggcctgcgccaatggctgcacgtcagggccagggctacccggggccccctatgcgctatggagagagttcctcttctccgttcccgcggggccccccgcgcagtactcggtgtgtggccctgacctgggtctgttccctgcatctcctcaggccaccttcctgtctgctgcccagggtctgggtctgtgcaccagacacacccagcctgcaggcccctcccacgtccttgccacctctgacctccgacctctgcagtgccctcggccctctcccagtgggagaagctctcgcctgggcccttggcacgagctgtgcctcctcttcctctctcccagcacagctgctccttcctgtctgccaggtcttggcctgtgtcctctccccgtgtgtcccccggtctgcaactgtcctgcctgtccttgtcacgagcactgtggggaggctccttgaggtgtggctgacgaagcggggagccctgcgtgtccaccctcatccgtcgtgcgggggtccacgggccatgaccgtgaggacgtgatgcagccctgcctccctctccacaggtcaccctccacggccaggatgtcctcatgctccctggtgacctcgttggcttgcagcacgacgctggccctggcgccctcctgcactgctcgccggctcccggccaccctggtccccgggccccgtacctctccgccaacgcctcgtcatggctgccccacttgccagcccagctggagggcacttgggcctgccctgcctgtgccctgcggctgcttgcagccacggaacagctcaccgtgctgctgggcttgaggcccaaccctggactgcggctgcctgggcgctatgaggtccgggcagaggtgggcaatggcgtgtccaggcacaacctctcctgcagctttgacgtggtctccccagtggctgggctgcgggtcatctaccctgccccccgcgacggccgcctctacgtgcccaccaacggctcagccttggtgctccaggtggactctggtgccaacgccacggccacggctcgctggcctgggggcagtgtcagcgcccgctttgagaatgtctgccctgccctggtggccaccttcgtgcccggctgcccctgggagaccaacgataccctgttctcagtggtagcactgccgtggctcagtgagggggagcacgtggtggacgtggtggtggaaaacagcgccagccgggccaacctcagcctgcgggtgacggcggaggagcccatctgtggcctccgcgccacgcccagccccgaggcccgtgtactgcagggagtcctagtggtgagtatggccgaggctccaccaccagcccccaggcaggtgcctgcagacagggtgctcacacagggcgtgaggcctggcttcccagtgagggcagcagcccagttactggggacgtcggccccgggcaggtcctgctggctggctcctcgggctacctggtgggctttaaattcctggaaagtcacggctctgacagtggctccgctaactcattccactgtctcatttcacaaaatgaatttaaaactctgctccctgacctcacacgagcccccgtgagtctctcacgccctctgctgtgttctcgcctggctaaagcgagtggcttttgaggtggagtctgaacccctgatgggaaactgcgggctgcccgcggtgccaccatgctgggtacatgggggacagggctgtctccatcttgcgggtacctgcctcttcaccaggggccttgggaggggccatcagaaatggcgtgacctgtgcagcctgtcctgggttctgtaagccagtgtaggtgcctcccctcactgctccgagctctctgggtgaggagctggggcaagagcgccgggagggtctgagaagactcagagagaggtggactctttgtagctggtactaggtttgctttacagatggggaaactgaggcacagagaggttgaggcattagtagtactacatggctggctggagagccggacagtgagtgtcccagcccgggcttggctcccatggcatgcagagccccgggcacctcctctcctctgtgccccgcgtgggactctccagcccgacgggaggtgtgtccaggaggcgacaggctaagggcagagtcctccacagagcccaggctgacaccattccccccgcagaggtacagccccgtggtggaggccggctcggacatggtcttccggtggaccatcaacgacaagcagtccctgaccttccagaacgtggtcttcaatgtcatttatcagagcgcggcggtcttcaagctctcagtaggtgggcgggggtggggaggggaggggatggggcggggcagggcgggggcgggctccaccttcacctctgccttctgctctgcttcatgctgcccgaggacgctgccatggctgtgggtgagtggagggagggacgccaatcagggccaggcctctcacctgccacctgggctcactgacgcctgtccctgcagctgacggcctccaaccacgtgagcaacgtcaccgtgaactacaacgtaaccgtggagcggatgaacaggatgcagggtctgcaggtctccacagtgccggccgtgctgtcccccaatgccacgctagcactgacggcgggcgtgctggtggactcggccgtggaggtggccttcctgtgagtgactcgggggccggtttggggtgggcaccaggctcttgtcccagccccagcctcagccgagggacccccacatcacggggttgcttttctgagcctcggtttccctgtctgttgggaggtaactgggtgcacaggagccctgaggctgcacgggagccgggagaggcctcagcacagccgggtgggccctgaatggaggcccggggcgtgactgcagagtggagcctcggctgggtcccaagcaccccctgccccgccaccgcccacccctgtcccggttcactcactgcgtcccaccgccccggcaggtggacctttggggatggggagcaggccctccaccagttccagcctccgtacaacgagtccttcccggttccagacccctcggtggcccaggtgctggtggagcacaatgtcatgcacacctacgctgccccaggtgagggatgagggggtgagggggccactgcctttcaggctctgagcacgggtccccccagctccccagtcaagctgccccccttcctccccaacagccctcactgtgacctcacctgggctgatggcttaggccctactggggtgagggaggggccaggcgtggggggagtggacagggaagctgggcccctgaactgcgccccccgccctccccgggcctggctcttgctgctctgctgccccgagtgcagctgcacttggaggcggtgcgtcctcgccaggcagccctcagtgctgctacacctgtgctccgtcccgcacgtggcttgggagcctgggacccttaaggctgggccgcaggtgcagccgttcaccccgggctcctcaggcggggggcttctgccgagcgggtggggagcaggtgggggtgccgcggctgccccactcgggcctgtccccacaggtgagtacctcctgaccgtgctggcatctaatgccttcgagaaccggacgcagcaggtgcctgtgagcgtgcgcgcctccctgccctccgtggctgtgggtgtgagtgacggcgtcctggtggccggccggcccgtcaccttctacccgcacccgctgccctcgcctgggggtgttctttacacgtgggacttcggggacggctcccctgtcctgacccagagccagccggctgccaaccacacctatgcctcgaggggcacctaccacgtgcgcctggaggtcaacaacacggtgagcggtgcggcggcccaggcggatgtgcgcgtctttgaggagctccgcggactcagcgtggacatgagcctggccgtggagcagggcgcccccgtggtggtcagcgccgcggtgcagacgggcgacaacatcacgtggaccttcgacatgggggacggcaccgtgctgtcgggcccggaggcaacagtggagcatgtgtacctgcgggcacagaactgcacagtgaccgtgggtgcggccagccccgccggccacctggcccggagcctgcacgtgctggtcttcgtcctggaggtgctgcgcgttgaacccgccgcctgcatccccacgcagcctgacgcgcggctcacggcctacgtcaccgggaacccggcccactacctcttcgactggaccttcggggatggctcctccaacacgaccgtgcgggggtgcccgacggtgacacacaacttcacgcggagcggcacgttccccctggcgctggtgctgtccagccgcgtgaacagggcgcattacttcaccagcatctgcgtggagccagaggtgggcaacgtcaccctgcagccagagaggcagtttgtgcagctcggggacgaggcctggctggtggcatgtgcctggcccccgttcccctaccgctacacctgggactttggcaccgaggaagccgcccccacccgtgccaggggccctgaggtgacgttcatctaccgagacccaggctcctatcttgtgacagtcaccgcgtccaacaacatctctgctgccaatgactcagccctggtggaggtgcaggagcccgtgctggtcaccagcatcaaggtcaatggctcccttgggctggagctgcagcagccgtacctgttctctgctgtgggccgtgggcgccccgccagctacctgtgggatctgggggacggtgggtggctcgagggtccggaggtcacccacgcttacaacagcacaggtgacttcaccgttaggtggccggctggaatgaggtgagccgcagcgaggcctggctcaatgtgacggtgaagcggcgcgtgcgggggctcgtcgtcaatgcaagccccacggtggtgcccctgaatgggagcgtgagcttcagcacgtcgctggaggccggcagtgatgtgcgctattcctgggtgctctgtgaccgctgcacgcccatccctgggggtcctaccatctcttacaccttccgctccgtgggcaccttcaatatcatcgtcacggctgagaacgaggtgggctccgcccaggacagcatcttcgtctatgtcctgcagctcatagaggggctgcaggtggtgggcggtggccgctacttccccaccaaccacacggtacagctgcaggccgtggttagggatggcaccaacgtctcctacagctggactgcctggagggacaggggcccggccctggccggcagcggcaaaggcttctcgctcaccgtctcgaggccggcacctaccatgtgcagctgcgggccaccaacatgctgggcagcgcctgggccgactgcaccatggacttcgtggagcctgtggggtggctgatggtggccgcctccccgaacccagctgccgtcaacaaaagcgtcaccctcagtgccgagctggctggtggcagtggtgtcgtatacacttggtccttggaggaggggctgagctgggagacctccgagccatttaccacccatagcttccccacacccggcctgcacttggtcaccatgacggcagggaacccgctgggctcagccaacgccaccgtggaagtggatgtgcaggtgcctgtgagtggcctcagcatcagggccagcgagcccggaggcagcttcgtggcggccgggtcctctgtgcccttttgggggcagctggccacgggcaccaatgtgagctggtgctgggctgtgcccggcggcagcagcaagcgtggccctcatgtcaccatggtcttcccggatgctggcaccttctccatccggctcaatgcctccaacgcagtcagctgggtctcagccacgtacaacctcacggcggaggagcccatcgtgggcctggtgctgtgggccagcagcaaggtggtggcgcccgggcagctggtccattttcagatcctgctggctgccggctcagctgtcaccttccgcctgcaggtcggcggggccaaccccgaggtgctccccgggccccgtttctcccacagcttcccccgcgtcggagaccacgtggtgagcgtgcggggcaaaaaccacgtgagctgggcccaggcgcaggtgcgcatcgtggtgctggaggccgtgagtgggctgcaggtgcccaactgctgcgagcctggcatcgccacgggcactgagaggaacttcacagcccgcgtgcagcgcggctctcgggtcgcctacgcctggtacttctcgctgcagaaggtccagggcgactcgctggtcatcctgtcgggccgcgacgtcacctacacgcccgtggccgcggggctgttggagatccaggtgcgcgccttcaacgccctgggcagtgagaaccgcacgctggtgctggaggttcaggacgccgtccagtatgtggccctgcagagcggcccctgcttcaccaaccgctcggcgcagtttgaggccgccaccagccccagcccccggcgtgtggcctaccactgggactttggggatgggtcgccagggcaggacacagatgagcccagggccgagcactcctacctgaggcctggggactaccgcgtgcaggtgaacgcctccaacctggtgagcttcttcgtggcgcaggccacggtgaccgtccaggtgctggcctgccgggagccggaggtggacgtggtcctgcccctgcaggtgctgatgcggcgatcacagcgcaactacttggaggcccacgttgacctgcgcgactgcgtcacctaccagactgagtaccgctgggaggtgtatcgcaccgccagctgccagcggccggggcgcccagcgcgtgtggccctgcccggcgtggacgtgagccggcctcggctggtgctgccgcggctggcgctgcctgtggggcactactgctttgtgtttgtcgtgtcatttggggacacgccactgacacagagcatccaggccaatgtgacggtggcccccgagcgcctggtgcccatcattgagggtggctcataccgcgtgtggtcagacacacgggacctggtgctggatgggagcgagtcctacgaccccaacctggaggacggcgaccagacgccgctcagtttccactgggcctgtgtggcttcgacacaggtcagtgcgtggcagggccgtcctccatgcccctcacccgtccacacccatgagcccagagaacacccagcttgccaccagggctggcccgtcctcagtgcctggtgggccccgtcccagcatggggagggggtctcccgcgctgtctcctgggccgggctctgctttaaaactggatggggctctcaggccacgtcgccccttgttctcggcctgcagagggaggctggcgggtgtgcgctgaactttgggccccgcgggagcagcacggtcaccattccacgggagcggctggcggctggcgtggagtacaccttcagcctgaccgtgtggaaggccggccgcaaggaggaggccaccaaccagacggtgggtgccgcccgcccctcggccacttgccttggacagcccagcctccctggtcatctactgttttccgtgttttagtgctggtggaggccgcacgctctcccctctctgtttctgatgcaaattctatgtaacacgacagcctgcttcagctttgcttccttccaaacctgccacagttccacgtacagtcttcaagccacatatgctctagtggcaaaagctacacagtcccctagcaataccaacagtgaggaagagccccttcccaccccagaggtagccactgtccccagcccatgtccctgttgctggatgtggtgggccggttctcaccctcacgctcccctctctggaccggccaggaggcttggtgaccctgagcccgtggtggctgctcctgctgctgtcaggcggggcctgctggtgccccagagtgggcgtctgttccccagtccctgctttcctcagctggcctgattgggggtcttcccagaggggtcgtctgaggggagggtgtgggagcaggttccatcccagctcagcctcctgacccaggccctggctaagggctgcaggagtctgtgagtcaggcctacgtggcagctgcggtcctcacacccacacatacgtctcttctcacacgcatccccccaggggccctcagtgagcattgcctgcctcctgctagggtccagctgggtccagtacaccagaacgcacactccagtgtcctctgccctgtgtatgcccttccgccgtccaagttggaaggtggcaaaccggatgagtatcctgggagggagtgagctcaccggcagtggccaggcccctgggaaacctggagtttgggagcagcatcctccatgggtcccccagtccttccagcaggccaaatagacctgtgttggaggtaaccccactcccacgccaggtgctgatccggagtggccgggtgcccattgtgtccttggagtgtgtgtcctgcaaggcacaggccgtgtacgaagtgagccgcagctcctacgtgtacttggagggccgctgcctcaattgcagcagcggctccaagcgaggggtgagtgttgagcggggtgtgggcgggctggggatgggtcccatggccgaggggacggggcctgcaggcagaagtggggctgacagggcagagggttgcgccccctcaccaccccttctgcctgcagcggtgggctgcacgtacgttcagcaacaagacgctggtgctggatgagaccaccacatccacgggcagtgcaggcatgcgactggtgctgcggcggggcgtgctgcgggacggcgagggatacaccttcacgctcacggtgctgggccgctctggcgaggaggagggctgcgcctccatccgcctgtcccccaaccgcccgccgctggggggctcttgccgcctcttcccactgggcgctgtgcacgccctcaccaccaaggtgcacttcgaatgcacgggtgagtgcaggcctgcgtggggggagcagcgggatcccccgactctgtgacgtcacggagccctcccgtgatgccgtggggaccgtccctcaggctggcatgacgcggaggatgctggcgccccgctggtgtacgccctgctgctgcggcgctgtcgccagggccactgcgaggagttctgtgtctacaagggcagcctctccagctacggagccgtgctgcccccgggtttcaggccacacttcgaggtgggcctggccgtggtggtgcaggaccagctgggagccgctgtggtcgccctcaacaggtgagccaggccgtgggagggcgcccccgagactgccacctgctcaccaccccctctgctcgtaggtctttggccatcaccctcccagagcccaacggcagcgcaacggggctcacagtctggctgcacgggctcaccgctagtgtgctcccagggctgctgcggcaggccgatccccagcacgtcatcgagtactcgttggccctggtcaccgtgctgaacgaggtgagtgcagcctgggaggggacgtcacatctgctgcatgcgtgcttgggaccaagacctgtacccctgcctggagctttgcagagggctcatcccgggccccagagataaatcccagtgaccctgaagcagcaccccgaccttccgctcccagcagccacacccaccgggccctctccggcgtctgctttccacaatgcagcccccgcccaggagggcccatgtgcttaccctgttttgcccatgaagaaacagctcagtgttgtgggtcagtgcccgcatcacacagcgtctagcacgtaactgcaccccgggagtcgtgggcatctgctggcctcctgccggcctcctgcgctgctgacagcttgctgtgccccctgcctgccccagtacgagcgggccctggacgtggcgcagagcccaagcacgagcggcagcaccgagcccagatacgcaagaacatcacggagactctggtgtccctgagggtccacactgtggatgacatccagcagatcgctgctgcgctggcccagtgcatggtaggatggccccacctgctcaccctgccccgcatgcctgccagggcactgggttcagccccccagggcagacgggcagcttggccgaggagctgagcctccagcctgggctccttcctgccatggcgttcctcggtctctgacctgcttcagtagcctcagccgttctgtcctgtgtgaacgcagggtgcctctcgggggacccagggtgtaaagaggggcccagatgtggggagggactaagaagatgctgctctgtgccctccactctcccctcccctcccctcccccttccctcccctagcccctcccctcctcccctcccctagcccttcccctcctcccctcccctagccctttcccttcttcccccccagcccttcccctcctcccctcccctagcccttcccctcctcccctcccctaccccttcccctcctcccctcccctagaccttcccctcacctcctcccgctgagcccctccactcgtcccccagcccctccctcccctagcccctcccctcccccttcctcccctcctccccctcccctcctccccctccctcttcctccccctcccctcctcccccttcctcccctctcctccccctcccctcctgtcccccctcctcccctcctccctcctcccctcctcccccctcctcctccccctcctccctcctccctcctccccctcctcctcctcccctcctccctcctcccctcctcccctcccctcctccccctcccccctcccttcctccccctcccccctcccctcctccccctctcctcctcccatccctcctcccatccctcctccccgttcccattctctcccctcccccttccatttctccctcctccccctgccctcctctcctcctcacctccccttctccgctcctttcttctcctccctccctttctctcctccctccccttctccccttctcctcttctccccttctcctctcttttcatccttcccttcttccctcctttcctcctcttttccctcttctcccccctcctcccctccttcctcctcccattccccctcctcccccctcccattccccctcctcccctccttcctcctcccattacccctcctctcctcccctcctcccacccccctctcctcccggctcctctcctcccctcctcatccccctcctctccttccctcctaacccccctcctctcctcccctcctcatccccctcctctccttccctcctcctatcccccctcctctcctcccctcctcctattccccctcctctcctcccctccttcctcctcctctcctcccatgccccctcctcccctcctcccatccccctcctcccctcctccctcctcccatcccatccccctcctctcctccccttctctcccctcctctcctcccctcctctcctctcctcctctcctcccctcctcccatcccccctcctcccatcccccctcctctcctccccactcctctcctccccactcctctcctcccctcatccccctcctctctcctcccctccccctcctctccttccctcctcctttcctcccctccccctccttccccctcctccccctccttctccccatcccccttccccttctcctcctctcccctcccccttctctttttccctcctcctcccttcctcctcccctcttctccccttttcccttttctcttcctctcctccccttctcccctcctgtcctccctccctttctctctttctttcctccctttccttctcccctgttctcctcccttcccttctccccttttcttccctcctcctttcctcccctcctccttttctctgtttctcttcctttcccctccactttccccttcctttcccctctcctttctccttcctttcctctccccttctcttccttttcctctctccccttcttttccctcttcccctcccctcctcttcccctcccctcctcttcccctcccctcctcttcccctcccctcctcttcccctctcctcctcttcccctcccctcctctttccctcccctcttctcctcccctcctctcccctcttcccctcccctcctcttccctccccttcccctcccctcctcttccctccccttcccctcccctcctcttccctccccttcccctcctcttccttcctctcttcccctcccctcctcttccctcccctcttcccctccccttctcttctcctccccttctcttcccctccccttttcttccctctccttgtcttccctgccctcctcttccctcccctcctcttccctcccctcttcccctctcctcctcttccctcccctcttcctctttcctcttcccctcccctcctcctccctcccctttcccctcttcccctcccctccgcttccctcccctttctcccccttctctcccctcccctctccccccttctctcccctcccctctcccccttctctcccctcccctctcccccttctctcccctctcctctcccccttctctcccccttctctcccccttctctctccccttctctcccccttctctcccctccccccttctctcccctcccctctcccccttctctcccctcccctctcccctgtcctctcctctccacccttctctcccctcccctctcctctcccccttccctctcctctcccccttctctcccctcccctctcctctccccccttttctccactcccctctcctctctcccctcctcctccgctctcatgtgaagaggtgccttgtgtggtcggtgggctgcatcacgtggtccccaggtggaggccctgggtcatgcagagccacagaaaatgcttagtgaggaggctgtgggggtccagtcaagtgggctctccagctgcagggctgggggtgggagccaggtgaggacccgtgtagagaggagggcgtgtgcaaggagtggggccaggagcggggctggacactgctggctccacacaggggcccagcagggagctcgtatgccgctcgtgcctgaagcagacgctgcacaagctggaggccatgatgctcatcctgcaggcagagaccaccgcgggcaccgtgacgcccaccgccatcggagacagcatcctcaacatcacaggtgccgcggcccgtgccccatgccacccgcccgccccgtgcggccctttcctctgcctccctcctccccccaaccgcgtcgcctttgccccatcccatcttcgtccccctcccctccccccaattcccatcctcatccccctcccccaattcccattctcctccccctcccccttccctattaccatcccttttctccatctctctccccttttctccatttccccccccgtcctccccgtccttttgtccattcccctcatcttcctcatccccctcatcccccttcccctcccttatcccccttcccctccctttccccctgctcctcttcttctcccttctcttttctctacccttttccttcctttttcctccctctccccatcatccccctcatcttcgtcctcatccccatcaccttccccctcccccctccaccactctctctccagcttcccccttccttctgcctgcacctcgctctctgccccctcaggttccccctttctcccagcccccaccctccggctccccctttttgcctgcccccaccctccctctacctccctgtctctgcactgacctcacgcatgtctgcaggagacctcatccacctggccagctcggacgtgcgggcaccacagccctcagagctgggagccgagtcaccatctcggatggtggcgtcccaggcctacaacctgacctctgccctcatgcgcatcctcatgcgctcccgcgtgctcaacgaggagcccctgacgctggcgggcgaggagatcgtggcccagggcaagcgctcggacccgcggagcctgctgtgctatggcggcgccccagggcctggctgccacttctccatccccgaggctttcagcggggccctggccaacctcagtgacgtggtgcagctcatctttctggtggactccaatccctttccctttggctatatcagcaactacaccgtctccaccaaggtggcctcgatggcattccagacacaggccggcgcccagatccccatcgagcggctggcctcagagcgcgccatcaccgtgaaggtgcccaacaactcggactgggctgcccggggccaccgcagctccgccaactccgccaactccgttgtggtccagccccaggcctccgtcggtgctgtggtcaccctggacagcagcaaccctgcggccgggctgcatctgcagctcaactatacgctgctggacggtgcgtgcagcgggtggggcacacgcggccccctggccttgttcttggggggaaggcgtttctcgtagggcttccatgggtgtctctggtgaaatttgctttctgtttcatgggctgctgggggcctggccagagaggagctgggggccacggagaagcaggtgccagctctggtgcagaggctcctatgctttcaggcccgtggcagagggtgggctcaggagggccatcgtgggtgtcccccgggtggttgagcttcccggcaggcgtgtgacctgcgcgttctgccccaggccactacctgtctgaggaacctgagccctacctggcagtctacctacactcggagccccggcccaatgagcacaactgctcggctagcaggaggatccgcccagagtcactccagggtgctgaccaccggccctacaccttcttcatttccccggggtgagctctgcgggccagcctggcagggcagggcagggcatcatgggtcagcattgcctgggttactggccccatggggacggcaggcagcgaggggactggaccgggtatgggctctgagactgcgacatccaacctggcggagcctgggctcacgtccgctaccccttccctgcccaggagcagagacccagcggggagttaccatctgaacctctccagccacttccgctggtcggcgctgcaggtgtccgtgggcctgtacacgtccctgtgccagtacttcagcgaggaggacatggtgtggcggacagaggggctgctgcccctggaggagacctcgccccgccaggccgtctgcctcacccgccacctcaccgccttcggcgccagcctcttcgtgcccccaagccatgtccgctttgtgtttcctgtgagtgaccctgtgctcctgggagcctctgcagagtcgaggagggcctgggtgggctcggctctatcctgagaaggcacagcttgcacgtgacctcctgggcccggcggctgtgtcctcacaggagccgacagcggatgtaaactacatcgtcatgctgacatgtgctgtgtgcctggtgacctacatggtcatggccgccatcctgcacaagctggaccagttggatgccagccggggccgcgccatccctttctgtgggcagcggggccgcttcaagtacgagatcctcgtcaagacaggctggggccggggctcaggtgaggggcgcagcggggtggcagggcctcccctgctctcactggctgtgctggttgcaccctctgggagtgagtctcgtcgcaggcgtcagaacaaggcagtttttgcagtgctgtgtgaagggctcgtgtgttcatcctgggaatgacctcgtgagcactcactgtccctgaggactaggacagctcctagctggaagtaggtgccagtcagtcagggtgggcagcccacgttctgcacagtagcgtggccccacaagtgacgtgagcatcgctaccactgtgggagactgtgcatccacccgcgatcctgactgcatagctcgtctctcagacggaggcgccagcaccctccccgtggctgtttcttcagtacctccattttcctttcattggaattgcccttctggcattccctttttgttttcgtttttctttttttagagacggagtctcactctgttgcccaggctggagtgcaatggcatgatcttggctcacagcaacttccagctcccgggtttaagccattccccttaagcgattctcctgagtagctgggagtacaggtgcacaccaccacacccagttaatttttcaccatgtcagccaggcgaactcctgacctcaggtgatccgcctgcctcggcctgccagagtgctgggatgacaggtgtgagccaccacacctggctgtgttcccattttttatctctgtgctgctttcctcttcattgcccagttctttcttttgattacctacttttaaaaactgtcggccgggcgcggtggctcacacctgtaatccgagcactttgggaggccaggcaggcaaatcacggggtcaggagatcgagaccatcctggctaacggtgaaaccctgtctctaataaaaagtacaaaaaaattagcccggcgtagtggcaggcgcctgtagtcccagctccttgggagactgaggcaggagaatggcgtgaacccgggaggcggagcttgcagtgagctgagattgcgccactgcactccagcctgggtgacacagcaagactccatctcaaaaaaaaaagaaaaaaaatactgtcacctgggtctgtcactgggagaggaggtgacacagcttcacgctttgcagtctgtgcatgaactgagggacgggtgtgtggtgcgggtcaccggttgtggcatgactgaggcgtggacaggtgtgcagtgcgggtcactggttgtggtgtggactgaggcgtgtgcagccatgtttgcatgtcacaagttacagttctttccatgtaacttaatcatgtccttgaggtcctgctgttaattggacaaattgcagtaaccgcagctccttgtgtatggcagagccgtgcaaagccgggactgcctgtgtggctccttgagtgcgcacaggccaaagctgagatgacttgcctgggatgccacacgtgttgggcagcagaccgagcctcccacccctccctcttgcctcccaggtaccacggcccacgtgggcatcatgctgtatggggtggacagccggagcggccaccggcacctggacggcgacagagccttccaccgcaacagcctggacatcttccggatcgccaccccgcacagcctgggtagcgtgtggaagatccgagtgtggcacgacaacaaaggtttgtgcggaccctgccaagctctgcccctctgcccccgcattggggcgccctgcgagcctgacctccctcctgcgcctctgcagggctcagccctgcctggttcctgcagcacgtcatcgtcagggacctgcagacggcacgcagcgccttcttcctggtcaatgactggctttcggtggagacggaggccaacgggggcctggtggagaaggaggtgctggccgcgagtaaggcctcgttccatggtcccactccgtgggaggttgggcagggtggtcctgccccgtggcctcctgcagtgcggccctccctgccttctaggcgacgcagcccttttgcgcttccggcgcctgctggtggctgagctgcagcgtggcttctttgacaagcacatctggctctccatatgggaccggccgcctcgtagccgtttcactcgcatccagagggccacctgctgcgttctcctcatctgcctcttcctgggcgccaacgccgtgtggtacggggctgttggcgactctgcctacaggtgggtgccgtaggggtcggggcagcctcttcctgcccagcccttcctgcccctcagcctcacctgtgtggcctcctctcctccacacagcacggggcatgtgtccaggctgagcccgctgagcgtcgacacagtcgctgttggcctggtgtccagcgtggttgtctatcccgtctacctggccatcctttttctcttccggatgtcccggagcaaggtgggctggggctggggacccgggagtactgggaatggagcctgggcctcggcaccatgcctagggccgccactttccagtgctgcagccagagggaaaggcgtccaccaaaggctgctcgggaagggtcaacacacttgagcagccttagctagactgaccagggagaaagagagaagactcagaagccagaatggtgaaagaacgagggcactttgctaagcagacgccacggacgactgcacagcagcacgccagataactcagaagaagcaagcacgcggctgtgcacgcttccgaaatgcactccagaagaaaatctcagtacatctataggaagtgaagaggctgagttagtcccttagaaacgtcccagtggccgggccgggtgtggtggctcacgcctgtaatcccaacacttcaggtggccgaggtgggcggatctgagtccaggagtttgagaccagcctgggcaacatagcaagaccccatctatataaaacattaaaaagggccaggcgcggtggctcacgcctgtaatcccagcactttgggaggccgaggcgggcagatcacttgaggtcaggagttcgagaccagcctggccaacacaatgaaaccccgactctactacaaatacaaaaacttagctgggcatggtggcgggcgcctgtagtcccagctactcgagaggctgaggcaggagaatggcatgaacccaggaggcggagcttgcagtgagccgagattgcgccactgcactccatcctgggcaacggagcaagactccatctccaaaaaaaaaaaaaaaaaatcccacaaagaaaagctcaggctcagagccttcacgatagaatttttctaagcagttaaggaagaattaacaccaatccttcacagactctttccaagaatacagcaggtgggaacgcttcccattcatacggaaacgggaggccgcaccccttaggaatgcacacgtggggtcctcaagaggttacatgcaaactaaccccagcagcacacagagaaggcgcataagccgcgaccaggaggggttgctcccgagtccgtggcaggaaccagaggccacatgtggctgctcgtatttaagttaattaaaatggaacgatggccgggtgtggtggctcacacctgtaatcccagcactttgggaggcggaggcgggcagatcacttgaggtcaggagttccaagaccagcctggccaacacagtgaaaccccgtctctactaaaaatacaaaaaattagctgggcatggtggcaggcacctgtaatcccagctactcaggaggctgagccaggacaatcgcctgaacgcgggaggtggaggttgcagtgagctgagattgcgccattgcactccagcctgggtgacagcgagactccatctaaaaaagaaaatatgaaatttaaaactctgttccttagctgcaccagtctgctgtcaagtgttcagtggcacacgtcgcgaggggctgccatcacggacggtgcagatgtcccatatatccagcattctaggacattctgtcagatggcaccgggctctgtcctgtctgctgaggaggtggcttctcatccctgtcctgagcaggtctgagctgccgcccgctgaccactgccctcgtcctgcaggtggctgggagcccgagccccacacctgccgggcagcaggtgctggacatcgacagctgcctggactcgtccgtgctggacagctccttcctcacgttctcaggcctccacgctgaggtgaggactctactgggggtcctgggctgggctgggggtcctgccgccttggcgcagcttggactcaagacactgtgcacctctcagcaggcctttgttggacagatgaagagtgacttgtttctggatgattctaagaggtgggttccctagagaaacctcgagccctggtgcaggtcactgtgtctggggtgccgggggtgtgcgggctgcgtgtccttgctgggtgtctgtggctccatgtggtcacaccacccgggagcaggtttgctcggaagcccagggtgtccgtgcgtgactggacgggggtgggctgtgtgtgtgacacatcccctggtaccttgctgacccgcgccacctgcagtctggtgtgctggccctccggcgagggaacgctcagttggccggacctgctcagtgacccgtccattgtgggtagcaatctgcggcagctggcacggggccaggcgggccatgggctgggcccagaggaggacggcttctccctggccagcccctactcgcctgccaaatccttctcagcatcaggtgagctggggtgagaggagggggctctgaagctcacccttgcagctgggcccaccctatgcctcctgtacctctagatgaagacctgatccagcaggtccttgccgagggggtcagcagcccagcccctacccaagacacccacatggaaacggacctgctcagcagcctgtgagtgtccggctctcgggggaggggggattgccagaggaggggccgggactcaggccaggcagccgtggttcccgcctggggtagggtggggtggggtgccagggcagggctgtggctgcaccacttcacttctctgaacctctgttgtctgtggaaagagcctcatgggatccccagggccccagaaccttccctctagggagggagcaggctcatggggctttgtaggagcagaaaggctcctgtgtgaggctggccggggccacgtttttatcttggtctcagagcagtgagaaattatgggcgggtttttaaataccccatttttggccgggcgcggtggctcacacgtgtaatcccagcactttgggaggccgaggtgggcagatgacctgaggtcagcagttcgagaccagcctggccaacatggcgaaaccccgtctctactaaaaatacaaaaaattagccgggcatgctggcaggcgcctgtagtcccagttactcgggagactgaggtaggagaatcgattgaacctggtaggtgaaggttgtagtgagccgagatcgcgccactgcactccagcctgggcaacaagagcgaaactccgtctcaaaaacaaaaaaattcctcaatttcttggttgttttgtaacttatcaacaaatggtcatatagaggttaccttgtatgtagtcacgcacatagtcacgcacatggcagccggcggcggagcgcacccacggcgtgttcccacgcgtgtgaccccgggctctgccatgccctcctatgctcaggtgtgctgaggtccacacggccctgccgttgcactgcagctgcctgcaggattcagtgcagtggcatgcagtgcaggtgcggtgccccggagccacaggccacaccacagggcctgcatgcacaggggctgcggtgtctgggtttgggtaactacgccctgtgacatttgcacagcaacagaattacctaatgacgcatttctcagaacacatccctggcactaagtggtgcgtgactgctgcttttgcatccacatctagtttgatttgtgtgttattcctttgagtgcttctcattgttaagcaaccaagaactaaagaggtatgaactgcccctggactcaaacaaaaaggaaaacttcctgatttacaaaaggcagataaccatcacatgagggcatctttatgaataaattgctggttggttttaaaaatacagagtatggggaaatccaggggtagtcactacatgctgaccagccccaggtatctccggcccaaagctctgtgaaatccagattcagtgcttccgcggggatttctgacggcagctcagactccgcatccacacagagcgcgtggccctcaccctcccggcttcctcaacccttggccgtcccttgctcggacagtgcttcgggctgaccaggtcggaggcttgggtttgtcctggacccctctgcgtccttcctcactgcagcctccagcgcgtcccgtggctcctttcccaacgcagagcacggccttccctgcgcctgagcctgcaccctccgtcctggcggcgcctctgccctggcattccctgccactccatgcctccctattggccattctccgtctctgccagcgagagcctgctccctgagtcagaccctgagtcatttgtgttgctataaaggaatagttgaggctgggttattttttatttttatttatttttttgagatggagtctctgttgcccagactggagtgcagtcgcatgatctcggctcactgcaaagtctgcctcccacgttcaagcagttatctgcctcagcctcccaagtagctaagattacaggcgcccgccgccacagccggctaattttttgtgtgtgtgttttagtagagaggaggtttcaccatcttagccaggctggtcttgaactcctgacctcgtgatccacccatctcagcctcccaaaatgctgagattacaggcgtgagccaccacgcctgaccaagttgaggctaggtcattttttaattttttgtaaagacagggtctcactgtctccaactcctgagctcaagtgatcctcctgcctcagcctcctgaagtgctgggattacaggcttgagacactgcgcccagccaagagtgtcttttatcctccgagagacagcaaaacaggaagcattcagtgcagtgtgaccctgggtcaggccgttctttcggtgatgggctgacgagggcgcaggtacgggagagcgtcctgagagcccgggactcggcgtctcgcagttggtctcgtcctccccctcaacgtgtcttcgctgcctctgtacctcttctctagcagctctgggaccgggcatatcagcatggtggcccgatgcagtggcacagcctcggtggtcactggctcctggagacacaagcagatctctggcctcagggagccctacacactgttgggatttgaaaggcattcatatgtttccttgtccagaagttaattttaggccataaacctgcatgggacagacacactggcgtctctagattgtagagatgcttgttggatggttgagacccaatcatagtttgcagggttgaaggggggctcattgcaccctgagagactgtgcactgctgtaagggcagctggtcaggctgtgggcgatgggtttatcagcagcaagcgggcgggagagggacgcaggcggacgcctgacttcggtgcctggagtggctcttggttccctggctcccagcaccactcccactctcgtttggggtagggtcttccggctttttgtcggggggaccctgtgacccaagaggctcaagaaactgcccgcccaggttaacatgggcttggctgcaactgcctcctggaggccgggatgaattcacagcctaccatgtccctcaggtccagcactcctggggagaagacagagacgctggcgctgcagaggctgggggagctggggccacccagcccaggcctgaactgggaacagccccaggcagcgaggctgtccaggacaggtgtgcttgcgtagccccgggatgcccctagcccctccctgtgagctgcctctcacaggtctgtctctgcttccccaggactggtggagggtctgcggaagcgcctgctgccggcctggtgtgcctccctggcccacgggctcagcctgctcctggtggctgtggctgtggctgtctcagggtgggtgggtgcgagcttccccccgggcgtgagtgttgcgtggctcctgtccagcagcgccagcttcctggcctcattcctcggctgggagccactgaaggtgagggggctgccaggggtaggctacaggcctccatcacgggggacccctctgaagccaccccctccccaggtcttgctggaagccctgtacttctcactggtggccaagcggctgcacccggatgaagatgacaccctggtagagagcccggctgtgacgcctgtgagcgcacgtgtgccccgcgtacggccaccccacggctttgcactcttcctggccaaggaagaagcccgcaaggtcaagaggctacatggcatgctgcgggtgagcctgggtgcggcctgtgcccctgccacctccgtctcttgtctcccacctcccacccatgcacgcaggacactcctgtccccctttcctcacctcagaaggcccttaggggttcaatgctctgcagcctttgcccggtctccctcctaccccacgccccccacttgctgccccagtccctgccagggcccagctccaatgcccactcctgcctggccctgaaggcccctaagcaccactgcagtggcctgtgtgtctgcccccaggtggggttccgggcagggtgtgtgctgccattaccctggccaggtagagtcttggggcgccccctgccagctcaccttcctgcagccacacctgccgcagccatggctccagccgttgccaaagccctgctgtcactgtgggctggggccaggctgaccacagggcccccccgtccaccagagcctcctggtgtacatgctttttctgctggtgaccctgctggccagctatggggatgcctcatgccatgggcacgcctaccgtctgcaaagcgccatcaagcaggagctgcacagccgggccttcctggccatcacgcggtacgggcatccggtgcactggtctgtcttctgggctttagttttgcctttagtccagccagaccctaggggacatgtggacatgtgtagatacctttgtggctgctagaactggaggtaggtgctgctggcatcagtaggcagaggggagggacacaggtccgtgtcttgcagtgcacaggacgggcccatgacagacaactgtctgccccagaacatccccaggataaggctgagaagcccaggtctagccgtggccagcagggcagtgggagccatgttccctgggtctctggtggccgctcactcgaggcgggcatggggcagtaggggctggagcgtgtgactgatgctgtggcaggtctgaggagctctggccatggatggcccacgtgctgctgccctacgtccacgggaaccagtccagcccagagctggggcccccacggctgcggcaggtgcggctgcaggaaggtgagctggcagggcgtgccccaagacttaaatcgttcctcttgttgagagagcagcctttagcggagctctggcatcagccctgctccctagctgtgtgacctttgccctcttaacaccgccgtttccttctctgtatatgagagatggtaacgttgtctaattgatggctgctgggagggttccctggggtggcgccgaaccagagctcaggcgagctggccagcaggaaacactcctgttgggttttgatgaggccctggccccggcctggggctctgtgtgtttcagcactctacccagaccctcccggccccagggtccacacgtgctcggccgcaggaggcttcagcaccagcgattacgacgttggctgggagagtcctcacaatggctcggggacgtgggcctattcagcgccggatctgctggggtgagcagagcgagggccccgggcgtctacgccaaggacaagggagtagttctccaggagtgccgcggcctcctgaccagcctggctccggggtgccggaagggctggggtgcggcacccacgccacccctctccggcagggcatggtcctggggctcctgtgccgtgtatgacagcgggggctacgtgcaggagctgggcctgagcctggaggagagccgcgaccggctgcgcttcctgcagctgcacaactggctggacaacaggtgggagctccctcccctgccctctccggggtggccgcagtcaccagccaggagcccaccctcactcctccggcccccgctggcctaggcggcttccacagcccctcagccacgcctgcactgcgcggtccccgcagctcccgccctgccacccgctcctactgacccgcaccctctgcgcaggagccgcgctgtgttcctggagctcacgcgctacagcccggccgtggggctgcacgccgccgtcacgctgcgcctcgagttcccggcggccggccgcgccctggccgccctcagcgtccgcccctttgcgctgcgccgcctcagcgcgggcctctcgctgcctctgctcacctcggtacgcccgtccccggccagaccccgcgcctcccaccggcagcgtcccgccccctcgcggggccccgcccggcagcgtctcacccctcgcagcgccccgccccctcgcagcgtcccgccccctcgcagggccccgccccggcagcgtcccgccccctcgtagggccccgccccggcagcgtcccgccccctcgcagggccccgccccggcagcgtccctcccgccctcctgaccgcgccccccacaggtgtgcctgctgctgttcgccgtgcacttcgccgtggccgaggcccgtacttggcacagggaagggcgctggcgcgtgctgcggctcggagcctgggcgcggtggctgctggtggcgctgacggcggccacggcactggtacgcctcgcccagctgggtgccgctgaccgccagtggacccgtttcgtgcgcggccgcccgcgccgcttcactagcttcgaccaggtggcgcagctgagctccgcagcccgtggcctggcggcctcgctgctcttcctgcttttggtcaaggtgagggctgggccggtgggcgcggggctgggcgcacaccccagggctgcaagcagacagatttctcgtccgcaggctgcccagcagctacgcttcgtgcgccagtggtccgtctttggcaagacattatgccgagctctgccagagctcctgggggtcaccttgggcctggtggtgctcggggtagcctacgcccagctggccatcctggtaggtgactgcgcggccggggagggcgtcttagctcagctcagctcagctgtacgccctcactggtgtcgccttccccgcagctcgtgtcttcctgtgtggactccctctggagcgtggcccaggccctgttggtgctgtgccctgggactgggctctctaccctgtgtcctgccgagtcctggcacctgtcacccctgctgtgtgtggggctctgggcactgcggctgtggggcgccctacggctgggggctgttattctccgctggcgctaccacgccttgcgtggagagctgtaccggccggcctgggagccccaggactacgagatggtggagttgttcctgcgcaggctgcgcctctggatgggcctcagcaaggtcaaggaggtgggtacggcccagtgggggggagagggacacgccctgggctctgcccagggtgcagccggactgactgagcccctgtgccgcccccagttccgccacaaagtccgctttgaagggatggagccgctgccctctcgctcctccaggggctccaaggtatccccggatgtgcccccacccagcgctggctccgatgcctcgcacccctccacctcctccagccagctggatgggctgagcgtgagcctgggccggctggggacaaggtgtgagcctgagccctcccgcctccaagccgtgttcgaggccctgctcacccagtttgaccgactcaaccaggccacagaggacgtctaccagctggagcagcagctgcacagcctgcaaggccgcaggagcagccgggcgcccgccggatcttcccgtggcccatccccgggcctgcggccagcactgcccagccgccttgcccgggccagtcggggtgtggacctggccactggccccagcaggacaccccttcgggccaagaacaaggtccaccccagcagcacttagtcctccttcctggcgggggtgggccgtggagtcggagtggacaccgctcagtattactttctgccgctgtcaaggccgagggccaggcagaatggctgcacgtaggttccccagagagcaggcaggggcatctgtctgtctgtgggcttcagcactttaaagaggctgtgtggccaaccaggacccagggtcccctccccagctcccttgggaaggacacagcagtattggacggtttctagcctctgagatgctaatttatttccccgagtcctcaggtacagcgggctgtgcccggccccaccccctgggcagatgtcccccactgctaaggctgctggcttcagggagggttagcctgcaccgccgccaccctgcccctaagttattacctctccagttcctaccgtactccctgcaccgtctcactgtgtgtctcgtgtcagtaatttatatggtgttaaaatgtgtatatttttgtatgtcactattttcactagggctgaggggcctgcgcccagagctggcctcccccaacacctgctgcgcttggtaggtgtggtggcgttatggcagcccggctgctgcttggatgcgagcttggccttgggccggtgctgggggcacagctgtctgccaggcactctcatcaccccagaggccttgtcatcctcccttgccccaggccaggtagcaagagagcagcgcccaggcctgctggcatcaggtctgggcaagtagcaggactaggcatgtcagaggaccccagggtggttagaggaaaagactcctcctgggggctggctcccagggtggaggaaggtgactgtgtgtgtgtgtgtgtgcgcgcgcgcacgcgcgagtgtgctgtatggcccaggcagcctcaaggccctcggagctggctgtgcctgcttctgtgtaccacttctgtgggcatggccgcttctagagcctcgacacccccccaacccccgcaccaagcagacaaagtcaataaaagagctgtctgactgcaatctgtgcctctatgtctgtgcactggggtcaggactttatttatttcactgacaggcaataccgtccaaggccagtgcaggagggagggccccggcctcacacaaactcggtgaagtcctccaccgaggagatgaggcgcttccgctggcccacctcatagccaggtgtgggctcggctggagtctgtgcaggggctttgctatgggacggagggtgcaccagaggtaggctggggttggagtaggcggcttcctcgcagatctgaaggcagaggcggcttgggcagtaagtctgggaggcgtggcaaccgctctgcccacacacccgccccacagcttgggcagccagcacaccccgctgagggagccccatattccctacccgctggcggagcgcttgatgtggcggagcgggcaatccacttggaggggtagatatcggtggggttggagcggctatgatgcacctgtgaggccatctggggacgtaggcagggggtgagctcactatcaggtggcacctgggcctgtcccaccagctcacgcctggacccacccccactcacatttgcgtgcagggccatctggcgggccacgaagggcaggttgcggtcagacacgatcttggccacgctgg

SEQ ID NO: 81 - DNA, 496 bp, Homo sapiens
tttttataataatttttgtaatttactttggatttataatatttctacataatgacatttggcaattttttgtttggttccccaatagtgaatccgaaactattaaagtggccaaaaatgatttcctaaggccctggaaaactcaggaatgcatccacttgcacttttcccatgcatggggaatcttcagagttttgcagccatgaagttaatatgtggtttcacaaggggaaacagtggcagaccacgcttgaattcggtcatgttctgaatcacttcaggttgtggcaaggctggtgcttgtgacaaatttatgtcattttgacatgggaactctccaacaacaggacaagaatccatttccctggcaagaacatggacggataccttatgtctccttggagcatctactgccaacatttccttgtagaatttgatgaaatcttccttggtaagtgtcttaaatatggcacctcagtgttatcctgtaaaatta

SEQ ID NO: 82 - DNA, 3262 bp, Homo sapiens
agggggcgaaggcggcggtggtgaggaagatactttggttagtgaccacatcgcagcatgttgagtcaagtttaccgctgtgggttccagcccttcaaccaacatcttctgccctgggtcaagtgtacaaccgtcttcagatctcattgtatccagccttcagtcatcagacatgttcgttcttggagcaacatcccgtttatcactgtacccctcagtcgtacacatggaaagtccttcgcccaccgcagtgagctgaagcatgccaagagaatcgtggtgaagctcggcagtgccgtggtgacccgaggggatgaatgtggcctggccctggggcgcttggcatctattgttgagcaggtatcagtgctgcagaatcagggcagagagatgatgctggtgaccagtggagccgtagcctttggcaaacaacgcttgcgccatgagatccttctgtctcagagcgtgcggcaggccctccactcggggcagaaccagctgaaagaaatggcaattccagtcttagaggcacgagcctgtgcagctgccggacagagtgggctgatggccttgtatgaggctatgtttacccagtacagcatctgtgctgcccagattttggtgaccaatttggatttccatgatgagcagaagcgccggaacctcaatggaacacttcatgaactccttagaatgaacattgtccccattgtcaacacaaatgatgctgttgtccccccagctgagcccaacagtgacctgcagggggtaaatgttattagtgttaaagataatgatagcctggctgcccgactggctgtggaaatgaaaactgatctcttgattgttctttcagatgtagaaggcctttttgacagccccccaggttcagatgatgcaaagcttattgatatattttatcccggagatcagcagtctgtgacatttggaaccaagtctagagtgggaatgggtggcatggaagccaaggtgaaagcagccctctgggctttgcaaggtggcacttctgttgttattgccaatggaacccacccaaaggtgtctgggcacgtcatcacagacattgtggaggggaagaaagttggtaccttcttttcagaagtaaagcctgcaggccctactgttgagcagcagggagaaatggcgcgatctggaggaaggatgttggccaccttggaacctgagcagagagcagaaattatccatcatctggctgatctgttgacggaccagcgtgatgagatcctgttagccaacaaaaaagacttggaggaggcagaggggagacttgcagctcctctgctgaaacgtttaagcctctccacatccaaattgaacagcctggccatcggtctgcgacagatcgcagcctcctcccaggacagcgtgggacgtgttttgcgccgcacccgaatcgccaaaaacttggaactggaacaagtgactgtcccaattggagttctgctggtgatctttgaatctcgtcctgactgtctaccccaggtggcagctttggctatcgcaagtggcaatggcttgttactcaaaggagggaaggaggctgcacacagcaaccggattctccacctcctgacccaggaggctctctcaatccatggagtcaaggaggccgtgcaactggtgaataccagagaagaagttgaagatctttgccgcctagacaaaatgatagatctgatcattccacgtggctcttcccagctggtcagagacatccagaaagctgctaaggggattccagtgatggggcacagcgaagggatctgtcacatgtatgtggattccgaggccagtgttgataaggtcaccaggctagtcagagactctaaatgtgaatatccagctgcctgtaatgctttggagactttgttaatccaccgggatctgctcaggacaccattatttgaccagatcattgatatgctgagagtggaacaggtaaaaattcatgcaggccccaaatttgcctcctatctgaccttcagcccctccgaagtgaagtcactccgaactgagtatggggacctggaattatgcattgaagtagtggacaacgttcaggatgccattgaccacatccacaagtatggcagctcccacacggatgtcatcgtcacagaggacgaaaacacagcggagttcttcctgcagcacgtagacagtgcctgtgtgttctggaatgccagcactcgcttttctgatggttaccgctttggactgggagctgaagtgggaatcagtacatcgagaatccacgcccggggaccagtaggacttgagggactgcttactactaagtggctgctgcgagggaaggaccacgtggtctcagatttctcagagcatggaagtttaaaatatcttcatgagaacctccctattcctcagagaaacaccaactgaaaagagccaggaaaacccgggaattttccaaaaggtcttcacgttaaacttgtcttatctcaggagagagcccgctcttgtctcccagttcctggtagggtctgcctgttggaaagtgtacctggatgcttctgggctccgtttggcaatagcaatcttggctgatgtgcacagtctggctcccagctcaccctttttttttaaagtaagaaaatagttgctaccgatagggactttgccaagtccaattatcttctaggattgaaaggtgcattttccccataaaaaaggcgaggaaaacccatggctgctttgtgtcacctcagtgacttacagtcccccttcgcatttagttggtactagagccagtcatccttaacaaatcttttcgcgttttatttctttcacatgtagtcatcttcaaaaaggaaagatttggaattttagaaaaggggcaactcttctttttagcattctcatcagaaagtcacaaaaatcgatggaatcatttccactgggaagattgaccttttgtatttatttgtggggtaaattaataagcattccagatgcttgcagcttcctgcatccaggagatgctgtgtcccccgtgatgcagctggaacccaagctgcagcaggagatgcaagtttcaggatgttccccactgagctggaggaatatctacagcagtgatgcttgaaatttttgtatgaattattttgtcgtcctacccttttcctccaaaacaaaaattagaggattattttaatactttggattcttcccccttttttgagaaataaagttttttatg

SEQ ID NO: 83 - DNA, 1022 bp, Homo sapiens
cacccccacctgccagagccttgatccctccctaggccctgcctaaccttgagttggccccaatccctcttggctgcagaagtccctttcacccccaatgagaggaggggcaggaccagatcttttgagagctgagggttgagggcattgagcaacacacagatttgtcgcctctgtccccgaagacacctgcaccctccatgcggagccaagatggggaatggaactgaggaagattataactttgtcttcaaggtggtgctgatcggcgaatcaggtgtggggaagaccaatctactctcccgattcacgcgcaatgagttcagccacgacagccgcaccaccatcggggttgagttctccacccgcactgtgatgttgggcaccgctgctgtcaaggctcagatctgggacacagctggcctggagcggtaccgagccatcacctcggcgtactatcgtggtgcagtgggggccctcctggtgtttgacctaaccaagcaccagacctatgctgtggtggagcgatggctgaaggagctctatgaccatgctgaagccacgatcgtcgtcatgctcgtgggtaacaaaagtgacctcagccaggcccgggaagtgcccactgaggaggcccgaatgttcgctgaaaacaatggactgctcttcctggagacctcagccctggactctaccaatgttgagctagcctttgagactgtcctgaaagaaatctttgcgaaggtgtccaagcagagacagaacagcatccggaccaatgccatcactctgggcagtgccaggctggacaggagcctggcctggggagaagagggcctgttgcatcagcctctgaccttggccagcaccacctgcccccactggctttttgtgccccttgtccccacttcagccccaggacctttccttgccctttggttccagatatcagactgttccctgttcacagcaccctcagggtcttaaggtcttcatgccctatcacaaatacctcttttatctgt

SEQ ID NO: 84 - DNA, 3413 bp, Homo sapiens
gtaactccaggacgagaccggagcgacccgcgcagcgagcataggcggcgaagctgcgcccggcgcccgagaccggcagctgcgtggggcgggggctgcgcccgagcccgatctgccggctccgagcagtggtctcggaaagagggtcgtggtcccgcacggatgcgcttgttgggagaaaccttggagattcacggcaaggcgtaaagcctggggcttccaacgatactctgggcagggatggaagcctagatgcctcaccgcaaggagcggccgagcgggtcctcgcttcacacacacggcagcaccggcaccgcggagggaggaaacatgtcccggctgtctctcacccggtcgcctgtgtctcccctggctgcccagggcatccccctgccagcccagctcaccaagtccaatgcacctgtgcacatcgatgtgggcagccacatgtacaccagcagcctggccacgctcaccaagtaccctgactccaggataagccgcctcttcaatggcactgaacccatcgtcctggacagtttgaagcaacattatttcattgaccgggatggggagattttccgctacgtcctgagcttcctgcggacgtccaagctgctgcttccggatgactttaaggacttcagtctgctgtacgaggaggcgcgctactatcagctccagcccatggtgcgcgagctggagcgctggcagcaggagcaggagcagcggcgccgcagccgggcctgtgactgcctggtggtgcgcgtcacgcccgacttgggcgagcggatcgcactcagcggcgagaaggccctcatcgaggaggtcttccccgagaccggagacgtcatgtgcaactccgtcaacgccggctggaaccaggaccccacgcacgtcatccgcttcccgctcaatggctactgccggctcaactcggtacaggatgttctataaaaatggcccagagtattttcaacaaagcgtgcttcatttgacacccagagtctgactttggattcgaactaaacccaggcaacaggcgaggcaggacagaggctgagtggaaaggtggtctggagccccttccctctccctgctgaccttggagtcgcaggcacccaccagctgccaagagaatccctggaccggctcttcctggatgggtccaagaattggacagctcagatggagtgagggcctattttccaacagctcttcgcagacccaagagcttggcacatttccgggttagggtggaatgggctttgcagggaagagggccccctgtgcacgcattccacagcctgtcggtcagaacttgctagttgcaggagacgggtgttacacgcagtcatcagacctcaccctcacagaggcacaaacccacatagttgtggacgcctgcagagactcaaatattgagaggacttctcctttttctctccctccagagctcccacgagctgatgcacccccaggcttcaaaccacctggaatgcacagctcagggaagctggtggatgcctagaggctgaaggacagggaactctccattattggggcaggactcagggaggacacttggggccatgtgtctggagagagggcataggttacaccctacagaataaagaagggacccaaagcctctttttgcctcccggaatcaaggccctgagggcagcaggatggtggcctgggtggggtcgtccaactaggtttgctaacctgaggggtcactgggcctggccacttctgtccctctggtggtggaacccagcacgtggttctgtagggacctttgtcagtgagcaagactgagatcgtcacaggagaaggtgcccttgctggctgccccagcaggcacccacctccctgccaggccaagccaggtgtcctcttgcagcttggccttgatgacctctgtttcttcctgggcaggtcctggagcggctgttccagaggggtttcagcgtggctgcgtcctgtgggggcggtgtggactcctcccagttcagcgagtatgtgctttgccgggaggagcggcggccgcagcccacccccactgctgttcgaatcaagcaggaacccctggactaggccctgcttcagtgcccacctgggcccccccagggacctggaaacagtgctggggagttctgcctgtgtatacttggccgtgggcatgagaccgagggtgaggctggagggtccaaagctggcccagcgagcaccagggtcccaggtgtcatggcaacagaacgtgggatgctggaggcatgcctgcagaaggactgttgatgcgacccaaagatacagcggtgggatctctgctgccagctctcccagcccctcagcttcgcagcctggcgcagcatcctctgaggccccggggcctgttggggcggggttggaagagccgtctgcagctacttcagaggagctgtttatccctctccacgcggggcagactctggcgggtctcctagcgtccgagagatggcttatttttctacagtatttaaaatggatgcagccctaactgcaaaagtcagagaggctgacaaggaccaatgcttctttatctggtgctcagttctcagtcagacgtgcagcatggctgcagggtggaccagctgcctggcattcaggcccagatgcctgcagggctggggctctcgggacagatgcagggatgtgtgctgcagggctgctgggaggagagtggtgggggcctgagggctgagtgattctgtaaccacctgagaccttcacgtttgctgccgttgggggctcaggctgcactccccgggtcacctgacctgctgcccaggggcttccagtcctgtctgtgtggactggcacctgggctgctggagaagtctcctcccgttcggaccagcctcagggctgcacgttacctcaggaatgggccccaccatgaaggggcccatctgtcagcagcgtcttctaggtccccagctcagggagccatccccagctccagttttctcatgcgaatatgcacagttttaattcacgttgttacactagcctgccgatgagacccagacacaggcagacctggcgctcttgacccctgattccagtgaggactggccctgaggagtccttgcagacctgctgcctgccccacgacaggcccaaagatggaccccccctggccttgtgacagctccccaagtgttctccggtggagaaactgcagaggactggtgggcggggctccccagccatcaccatcctgtgtacaatggctgtagacttgtatatggctcctttaatattgtaaagatgctgatgtacaattgtcgtgcatttgtgtgaacacattgcgttcccagtccatgccataaatgatgctctcaagcaaaaaaaaaaaaaaaaaa

SEQ ID NO: 85 - DNA, 1057 bp, Homo sapiens
gtctcagcggctgccaacagatcatgagccatcagctcctctggggccagctataggacaacagaactctcaccaaaggaccagacacagtgagcaccatgggacagtgtcggtcagccaacgcagaggatgctcaggaattcagtgatgtggagagggccattgagaccctcatcaagaactttcaccagtactccgtggagggtgggaaggagacgctgaccccttctgagctacgggacctggtcacccagcagctgccccatctcatgccgagcaactgtggcctggaagagaaaattgccaacctgggcagctgcaatgactctaaactggagttcaggagtttctgggagctgattggagaagcggccaagagtgtgaagctggagaggcctgtccgggggcactgagaactccctctggaattcttggggggtgttggggagagactgtgggcctggagataaaacttgtctcctctaccaccaccctgtaccctagcctgcacctgtcctcatctctgcaaagttcagcttccttccccaggtctctgtgcactctgtcttggatgctctggggagctcatgggtggaggagtctccaccagagggaggctcaggggactggttgggccagggatgaatatttgagggataaaaattgtgtaagagccaaagaattggtagtagggggagaacagagaggagctgggctatgggaaatgatttgaataatggagctgggaatatggctggatatctggtactaaaaaagggtctttaagaacctacttcctaatctcttccccaatccaaaccatagctgtctgtccagtgctctcttcctgcctccagctctgccccaggctcctcctagactctgtccctgggctagggcaggggaggagggagagcagggttgggggagaggctgaggagagtgtgacatgtggggagaggaccagctgggtgcttgggcattgacagaatgatggttgttttgtatcatttgattaataaaaaaaaatgaaaaaagtgaaaaaaaaaaaaaaaaa

SEQ ID NO: 86 - DNA, 2221 bp, Homo sapiens
agagcaaggaagggcaggggacctgggaaggaagttctggaaggcagtggggtttgagattggacccagggtcaagatagaacatgaaggtgggatgaggacatgaacagaacatggccaagaaggatctgggggagcagccaggacgaggcggagctgatccgagaggacatccagggggctctgcacaattaccgctcgggccgcggggagcgcagggcggcggcgctcagggccacgcaggaggagttgcagcgcgaccgctcgcccgccgctgagaccccgcccctgcagcgccgcccgtcagtccgcgcagtgatcagcaccgtagagcggggcgcgggccgcggacgaccccaggcgaagcccattcccgaggcagaggaggcgcagaggcctgagccggtggggacctcgagcaacgctgactcggcctccccggacctgggtccccggggtcctgacctggcggttctgcaggcggagcgggaagtggacatcctgaaccacgtgttcgacgacgtagagagctttgtatcgaggctgcagaagtcggcggaggcggccagggtgctggagcaccgggaacgcggccgcaggagccggcgccgggcggctggggagggcttgctgacgctgcgggccaagccgccctcggaggccgagtacaccgacgtgctgcagaagatcaagtacgccttcagcctgctggcccggctgcgcggcaacatcgccgacccctcctctccggagctgttgcacttccttttcgggcctctgcagatgattgtgaacacgtcgggggggccggagttcgcgagcagtgtgcggcggccgcatctgacatcggatgccgtggcgctgctgcgggacaacgtcactccacgtgaaaacgagctctggacctcgctgggggactcgtggacccgccccgggctggagctgtccccggaggagggacccccatacagacccgagttcttcagcggctgggagccgccggtcactgacccgcagagccgcgcctgggaggacccagttgagaaacagctacagcacgagcggaggcgccggcagcaaagcgccccccaggtcgctgtcaatggtcaccgagacttggagccagaatctgagcctcagctggagtcagagacagcaggaaaatgggtcctgtgtaattatgacttccaggcccgcaacagcagtgagctgtcggtcaagcagcgggacgtactggaggtcctggatgacagtcgtaagtggtggaaggttcgggacccagcggggcaggagggatatgtgccctacaacatcctgacaccctaccccggaccccggctgcaccacagccaaagccctgcccgcagcctgaacagcactcctcctccaccaccagccccagccccggccccacctccagctctggctcggccccgctgggacaggccccgctgggacagctgcgatagcctcaacggcttggaccccagcgagaaggagaaattctcccagatgctcatcgtcaacgaggaactgcaggcgcgcctggcccagggccgctcgggaccgagccgcgcagtcccagggccccgcgccccggaaccgcagctcagcccgggctcggacgcctccgaggtccgcgcctggctgcaggccaagggctttagctccgggaccgtggacgcgctgggtgtgctgaccggggcgcagcttttctcgctgcagagggaggagctgcgggcggtgagccccgaggagggggcacgtgtgtacagccaggtcaccgtgcagcgctcgctgctggaggacaaagagaaagtgtcagagctggaggcagtgatggagaagcaaaagaagaaggtggaaggcgaggtggaaatggaggtcatttgacctgccaggcgcccttcgcaaagagtgacgaggccccgtgggagaacggactcctcagactctccccaatagcggaagtcgatcttctgaaggatggccaatctgctccggccctggtcttcccccatcccggtggacagacttaacgatccttgctgcagtccctccggagaggatctggactggctgggagtggggagggcgtggagacagtctacggaaagcgctagcagacccccgagagggtgcagtggagccctgagcattgtaatatgcggcccagcctataaacagcctccgtgcttagcaaaaaaaaaaaaaaaaaaaa

SEQ ID NO: 87 - DNA, 2085 bp, Homo sapiens
ggctgcagttacagagtgctgccatcaccaagtatgtggcggacgtcctgccggggaagaatcaaagagcagagagcatggccagtgcagcgagggaactggttatccagcggttgagtctggtgaggagtctttgcgagagcgaggagcagcggttactggaacaggtgcatggcgaagaggagcgggcccaccagagcatcctgacacagcgggtgcactgggccgaggcgctgcagaaacttgacaccatccgcactggcctggtgggcatgcttactcacctggatgacctccagctgattcagaaggagcaagagattttcgagaggaccgaagaagcagagggcattttggatccccaggagtcggaaatgttaaactttaatgagaagtgcactcggagcccactactgacccaactctgggcaacggcggttcttgggtctctctcaggcacagaggacatacggatcgatgagaggacagtcagccccttcctgcaattgtcagatgatcgaaagaccctgaccttcagcaccaagaagtcaaaggcctgtgcagatggcccggagcgcttcgaccactggcccaatgccctggctgccacctccttccagaatgggctccatgcctggatggtgaatgtccagaacagttgtgcctataaggtgggcgtggcttcaggccacctgccccgcaagggttctggcagtgactgccgtctgggccacaatgccttctcctgggtcttctctcgctatgatcaggagtttcgtttctcacacaatgggcagcacgagcccctggggctgctgcggggcccagcccagctgggtgtagtgctggacttgcaggttcaggagctgctcttctatgagccagcctccggcatagtgctctgtgcccatcatgtgtccttcccggggcccctcttcccagtctttgctgtggccgatcagaccatttctatcgtccgctgacctctggccacaggaagccaggtccaccgcccaccaccctttcaggccatgtttctactcagtgtgcttttcccaaatgatgtgtgtggtgtttctaagagaaacagggcccataaccagtgggcagctttaggagggatggggatctgtttcagatctaggcataacctgtaaatcacaggtgtccaaacttttggcttccctgggccacatttgaagaagaattttcttgggccacataaaatacactaacgatagctgatgagctaaaaaaaaaaaaaaaagtctgtgtataatttttgtgatatctgccaccacagataagcaaaaaagtccttgcattcaaagggttggagattgctgctttgagtgctgggtacctgtggggaacctactactccctgggccttagtctcccaaatccaccatgcatctgcccctctgagggtgtcttcactttgtctctggcatctagcatggtgcctggtgcatagtgagcatgcaataaatatttggcaggtgagtggatggatagatggataggtgaatgtaggtggacaggtgactgggtggatgttgtggtctctggagaagcactgccattcagcctcctgctccagctgttcacatgcagaaatgctctcttcacaggcagagaagcctgtggctaaagtttccacatcccattaactcagtgcttttgtctttttcatgacatggcacatagagaaaatatttttttctagcacacaagagcaacctgaaaggctgctcctggctaggggactctgtcccgggggaccgtgtcctcccccatgtcctgcctaggccctcagaggaccaggggatcatgtctccaggtaacccgactgtagcccctgctggctgagctccagcctgtgcccactgataatagcagggacggcctttctcttagagcagctgataagtttccctacctgatggccccctctgacataaactgcacacctggggtgatggcttaaagccagaaagagctgagggagttaagagggccaaccttagggcacgtgggcattattaaaggtcttaaaagcattaaaaaaaaaaaaaaaaaaaa

SEQ ID NO: 88 - DNA, 2730 bp, Homo sapiens
agaatgcctatgagacacaggaagaaggcagcagacaagaatcttccctgccgtcctttagtatgtgcagtactggacctgatggtagagtttattgtaacacacatgatgaaggagtttcctatggatctctatatacgctgcatccaggtagtacacaaactgctctgctaccagaagaagtgtcgggtacgcctgcattacacctggcgggagctctggtcagccttgataaatttgctgaagttccttatgtcaaatgagactgtacttttggccaaacacaacatttttacattagcccttatgattgtgaacctatttaatatgtttatcacatatggcgacacatttctgccaacccccagcagctatgatgaactttactatgagattatccgcatgcaccagagctttgacaacctctactccatggtcctgaggctttctaccaatgcaggccagtggaaggaagcagctagcaaggtgacccatgcattggttaatatcagagccatcatcaaccactttaaccccaaaattgagtcctacgctgctgtgaatcacatatcccaactgtcagaggagcaggtgctggaggtggtgagagccaactatgacacgctcacgctgaagctgcaggatggcctggaccagtatgagcgctactcagagcagcacaaggaagctgccttcttcaaagagctggttcgatccattagcaccaacgtccggagaaacctggtcttccacacactcagccaagaagtcctgctcaaggagttctccactatctcctgaggccacgcctacctgagcagcctctgactgcccttacccatgaggatcatgggctggagggggagcgaggggagagggggctgcccccgaggttggagagaaacacagataccaagttctcttggtgaagaccgcacttcaatggagcttgggcagcaggggcaggagggtcaagccagggataatcttatttggggaggaatgggtgggcacagtggggagaggcctccaggaatgtggggacttccagagtgggctccctaaacagcccctcacatttccaatcttgaggttacaagctgtagctactgactaattttcgggagctggtgaggcaagcctcagggtaatgccagcaccctgaaagtcagtggctctgctcggcttctgaaaacagatcaactctcagatatagctggagctacatcctgcttcctttgggcctggggctgtgcttggcttgaaatctgtgtcccctgcctgcactggcactttgtccagtcatcgggacctttggctcagatttagggtaagataggaatagggtacctttttccttttttttctgagacggagtctcactctgtcgcccaggctggaatgcagtggcgtgatctcggctttactgcagcctccgcttcctgggttcaagcgattctcctgcctcagcctcccgagtagctgggactacaggagcgtgtgccacgcccggctaattttttgtatttttagtagagatggagtttcaccatgttacccaggatggtctcaatatcctgagttcatgatccacccaccttggcctcccaaagtgctgggattacaggcgtgagccaccacacccagccagttttcctattttctgaattcagaattgacttctctgggaaaactggagatgagaatctgcccagtgctctgctgtccagtcaccgccttttgaattttagttttggcaccaggagtaccgttagctttccccttcttctggcccatttgactcatcagcacaatagggtcaccaccttaacttttaatttctaatctgctttactgtctttagggtgtgtatgaaataaacattgacaggctttctggagccctcaaggtgcctactttgctggttccctttccagcagctcccccacctcccttagccccccctcctctggcagcctctcctgcctctgctgagctcccctccacgtgttccacccccttaccctgctgttgtttacatccaacctgcctgagaatttcctctggggaggaatctattcctgtcatggtctagtgcctgggagggagagaacttcctgggggtagggtgccctccatctgaaacaggccaggtgagcatcatgcataaggcctccattctgtccgctcagattctgggtggggccacaggcaaatctcctgacttatggggagttggcttgtggttcctcccttggatagcctccatggaaccactataggctttcccaacagctgcctctgaaatagctgctgcttcgagatcctccctttttaaagcactttctaaagccctcaggatggcgggagcaaacagcactggtatattctaggagtaagtgcaggaattcagcagtgagagcatgtctgggaccacctggactgccatccatttaacctcaaatctctttgggatactcgccctccctgggaaccagagttctggctctaacattgagcagctatgcactagttccagagaagccactaacaggctgccatgtgtagatgtaggttcttaagagatcacaggctgggtcatctgatcactggatggatagctcagcctggggcatttagtgttttccctggtgataaatccccaaggcagctggatttggagctggtggcaagttgaaattattaaaaattgatttgtgtgggactgtc

SEQ ID NO: 89 - DNA, 2079 bp, Homo sapiens
gagaggcagcagcttgttcagcggacaaggatgctgggcgtgagggaccaaggcctgccctgcactcgggcctcctccagccagtgctgaccagggacttctgacctgctggccagccaggacctgtgtggggaggccctcctgctgccttggggtgacaatctcagctccaggctacagggagaccgggaggatcacagagccagcatggtacaggatcctgacagtgatcaacctctgaacagcctcgatgtcaaacccctgcgcaaaccccgtatccccatggagaccttcagaaagtgtggggatccccatcatcatagcactactgagcctggcgagtatcatcattgtggttgtcctcatcaaggtgattctggataaatactacttcctctgcgggcagcctctccacttcatcccgaggaagcagctgtgtgacggagagctggactgtcccttgggggaggacgaggagcactgtgtcaagagcttccccgaagggcctgcagtggcagtccgcctctccaaggaccgatccacactgcaggtgctggactcggccacagggaactggttctctgcctgtttcgacaacttcacagaagctctcgctgagacagcctgtaggcagatgggctacagcagcaaacccactttcagagctgtggagattggcccagaccaggatctggatgttgttgaaatcacagaaaacagccaggagcttcgcatgcggaactcaagtgggccctgtctctcaggctccctggtctccctgcactgtcttgcctgtgggaagagcctgaagaccccccgtgtggtgggtggggaggaggcctctgtggattcttggccttggcaggtcagcatccagtacgacaaacagcacgtctgtggagggagcatcctggacccccactgggtcctcacggcagcccactgcttcaggaaacataccgatgtgttcaactggaaggtgcgggcaggctcagacaaactgggcagcttcccatccctggctgtggccaagatcatcatcattgaattcaaccccatgtaccccaaagacaatgacatcgccctcatgaagctgcagttcccactcactttctcaggcacagtcaggcccatctgtctgcccttctttgatgaggagctcactccagccaccccactctggatcattggatggggctttacgaagcagaatggagggaagatgtctgacatactgctgcaggcgtcagtccaggtcattgacagcacacggtgcaatgcagacgatgcgtaccagggggaagtcaccgagaagatgatgtgtgcaggcatcccggaagggggtgtggacacctgccagggtgacagtggtgggcccctgatgtaccaatctgaccagtggcatgtggtgggcatcgttagctggggctatggctgcgggggcccgagcaccccaggagtatacaccaaggtctcagcctatctcaactggatctacaatgtctggaaggctgagctgtaatgctgctgcccctttgcagtgctgggagccgcttccttcctgccctgcccacctggggatcccccaaagtcagacacagagcaagagtccccttgggtacacccctctgcccacagcctcagcatttcttggagcagcaaagggcctcaattcctgtaagagaccctcgcagcccagaggcgcccagaggaagtcagcagccctagctcggccacacttggtgctcccagcatcccagggagagacacagcccactgaacaaggtctcaggggtattgctaagccaagaaggaactttcccacactactgaatggaagcaggctgtcttgtaaaagcccagatcactgtgggctggagaggagaaggaaagggtctgcgccagccctgtccgtcttcacccatccccaagcctactagagcaagaaaccagttgtaatataaaatgcactgccctactgttggtatgactaccgttacctactgttgtcattgttattacagctatggccactattattaaagagctgtgtaacatcaaaaaaaaaaaaaaaaaaaa

SEQ ID NO: 90 - DNA, 2378 bp, Homo sapiens
aattccctccgccgcggtcgctgagcgagtgcggcgggaatgcggaaccggcgcgcgggctgaggccgcccgggatggcgcaggggcggcggcggcgggcggcctgcgcggggccctagcgagccgggctgacgctcccggccccggccccggcatcggcatcgcgggcgcatcgcggccatggccaaggagcggcgcagggcggtcctggagctgctgcagcggccggggaacgcgcgctgcgcggactgcggcgccccggatcccgactgggcctcctacactctgggcgtcttcatctgcctgagctgctcgggaatccaccggaatatcccccaggtcagcaaggtgaagtccgtccgcctggacgcctgggaggaggcccaagtggagttcatggcctcccacgggaacgacgccgcgagagccaggtttgagtccaaagtaccctccttctactaccggcccacgccctccgactgccagctccttcgagagcagtggatccgggccaagtacgagcgacaggagttcatctacccggagaagcaggagccctactcggcagggtaccgtgagggttttctctggaagcgtggccgggacaacgggcagtttttgagccggaagtttgtgctgacagaacgagagggtgctctgaagtatttcaacagaaatgatgccaaggagcccaaggccgtgatgaagatcgagcacctgaatgccaccttccagccggccaagatcggccacccccacggcctgcaggtcacctacctgaaggacaacagcacccgtaacatcttcatctaccatgaggacgggaaggagattgtggactggttcaatgcactccgagctgctcgcttccactacctgcaggtggcattcccaggggccagcgacgcagatctggtgccaaagctctccaggaactacctgaaggaaggctacatggagaagacggggcccaagcaaacggaaggcttccggaagcgctggttcaccatggatgaccgcaggctcatgtacttcaaagaccccctggacgccttcgcccgaggggaagtcttcattggcagcaaggagagtggctacacggtgctgcatgggttcccgccgtccacccagggccaccactggccacatggcatcaccatcgtcacgcccgaccgcaagtttctgtttgcctgcgagacggagtccgaccagagggagtgggtggcggccttccagaaggcggtggacaggcccatgctgccccaggagtacgcagtggaggcgcacttcaagcataaaccttagcgagtgcggctggaggaccacggacattggactcactgtggctggacggaggggacccgtggatgggggggctctggcgtcctgaggccacctggccccacctgctcctcagggcagcccggcgcggccaggtagggcccgagcttcagcttccaggatgcttctctggaacctcaaggcaggcagcccaggccctgggcctgatctctaaccccgtcatgctgctgctgaccacacccagccaacctgcccctccctgacccggggccccctttcctccagggcccagtctggctcccgagctcagacacagcccccaggagccgcccaccacggctgtgggaacttccaggcctcagcgcagagccctgcttggggccagcacggtgggcagctgccggccgctggggactgggccctgctcgcatgccgccccgccctccccccacctccacgactatttattgagcgcctgttgtgtgtcacggggctatgagggccgtggggtgtttgggtggattatccacacaggtcccggcccctgcccgggctggagttgccacagcctgtgctcctggtcctcacctggaggggccagcaggctgccgtcccaccacacgtggcctctgcgcccagcacggtgctcgccgacagtggtgtctgaacccttggggacgagggcctgggccgcggtgaggccaccagaggcaggagtggccctgggggtcccgggcactgtcgcgcttgctgcaggcggcccagccgtgtatttatttttcacctatctccttcctgtcaaggcaggccgggctccagggctccccttgcgtggggcatgtaggtgggggaggcgtctgcaggtcacctggggggcccagccctctcccagccttgcctggctgagctgtgttccaggggagccctggacaagccctcataggcagggagggggtttccgaggccaggcatccgccgccccgtgtcgcatcctggaataaaatgtggctctggcatggttaaaaaaaaaaaaaaaaaaaaaaaaaaaaaaaaaaaaaaaaaaaaaaaaaaaaaaa

SEQ ID NO: 91 - DNA, 4793 bp, Homo sapiens
attggatcaaacatgtcacaagagtcggacaataataaaagactagtggccttagtgcccatgcccagtgaccctccattcaatacccgaagagcctacaccagtgaggatgaagcctggaagtcatacttggagaatcccctgacagcagccaccaaggccatgatgatcattaatggtgatgaggacagtgctgctgccctcggcctgctctatgactactacaaggttcctcgagacaagaggctgctgtctgtaagcaaagcaagtgacagccaagaagaccaggagaaaagaaactgccttggcaccagtgaagcccagagtaatttgagtggaggagaaaaccgagtgcaagtcctaaagactgttccagtgaacctttccctaaatcaagatcacctggagaattccaagcgggaacagtacagcatcagcttccccgagagctctgccatcatcccggtgtcgggaatcacggtggtgaaagctgaagatttcacaccagttttcatggccccacctgtgcactatccccggggagatggggaagagcaacgagtggttatctttgaacagactcagtatgacgtgccctcgctggccacccacagcgcctatctcaaagacgaccagcgcagcactccggacagcacatacagcgagagcttcaaggacgcagccacagagaaatttcggagtgcttcagttggggctgaggagtacatgtatgatcagacatcaagtggcacatttcagtacaccctggaagccaccaaatctctccgtcagaagcagggggagggccccatgacctacctcaacaaaggacagttctatgccataacactcagcgagaccggagacaacaaatgcttccgacaccccatcagcaaagtcaggagtgtggtgatggtggtcttcagtgaagacaaaaacagagatgaacagctcaaatactggaaatactggcactctcggcagcatacggcgaagcagagggtccttgacattgccgattacaaggagagctttaatacgattggaaacattgaagagattgcatataatgctgtttcctttacctgggacgtgaatgaagaggcgaagattttcatcaccgtgaattgcttgagcacagatttctcctcccaaaaaggggtgaaaggacttcctttgatgattcagattgacacatacagttataacaatcgtagcaataaacccattcatagagcttattgccagatcaaggtcttctgtgacaaaggagcagaaagaaaaatccgagatgaagagcagaagcagaacaggaagaacgggaaaggccaggcctcccaaactcaatgcaacagctcctctgatgggaagttggctgccatacctttacagaagaagagtgacatcacctacttcaaaaccatgcctgatctccactcacagccagttctcttcatacctgatgttcactttgcaaacctgcagaggaccggacaggtgtattacaacacggatgatgaacgagaaggtggcagtgtccttgttaaacggatgttccggcccatggaagaggagtttggtccggtgccttcaaagcagatgaaagaagaagggacaaagcgagtgctcttgtacgtgaggaaggagactgacgatgtgttcgatgcattgatgttgaagtctcccacagtgatgggcctgatggaagcgatatctgagaaatatgggctgcccgtggagaagatagcaaagctttacaagaaaagcaaaaaaggcatcttggtgaacatggatgacaacatcatcgagcactactcgaacgaggacaccttcatcctcaacatggagagcatggtggagggcttcaaggtcacgctcatggaaatctagccctgggtttggcatccgctttggctggagctctcagtgcgttcctccctgagagagacagaagccccagccccagaacctggagacccatctcccccatctcacaactgctgttacaagaccgtgctggggagtggggcaagggacaggccccacagtcggtgtgcttggcccatccactggcacctaccacggagccgaagcctgagcccctcaggaaggtgccttaggcctgttggattcctatttattgcccaccttttcctggagcccaggtccaggcccgccaggactctgcaggtcactgctagctccagatgagaccgtccagcgttcccccttcaagagaaacactcatcccgaacagcctaaaaaattcccatcccttctttctcacccctccatatctatatctcccgagtggctggacaaaatgagctacgtctgggtgcagtagttataggtggggcaagaggtggatgcccactttctggtcagacacctttaggttgctctggggaaggctgtcttgctaaatacctccagggttcccagcaagtggccaccaggccttgtacaggaagacattcagtcaccgtgtaattagtaacacagaaagtctgcctgtctgcattgtacatagtgtttataatattgtaataatatattttacctgtggtatgtgggcatgtttactgccactggcctagaggagacacagacctggagaccgttttaatgggggtttttgcctctgtgcctgttcaagagacttgcagggctaggtagagggcctttgggatgttaaggtgactgcagctgatgccaagatggactctgcaatgggcatacctgggggctcgttccctgtccccagaggaagccccctctccttctccatgggcatgactctccttcgaggccaccacgtttatctcacaatgatgtgttttgcctgactttccctttgcgctgtctcgtgggaaaggtcattctgtctgagaccccagctccttctccagctttggctgcgggcatggcctgagctttctggagagcctctgcagggggtttgccatcagggccctgtggctgggtctgctgcagagctccttggctatcaggagaatcctggacactgtactgtgcctcccagtttacaaacacgcccttcatctcaagtggccctttaaaaggcctgctgccatgtgagagctgtgaacagctcagctctgagtcggcagactggggcttcctcctgggccaccagatggaaagggggtattgtttgcctcactcctggatgctgcgttttaaggaagtgagtgagaaagaatgtgccaagatacctggctcctgtgaaaccagcctcaggagggaaactgggagagagaagctgtggtctcctgctacatgccctgggagctggaagagaaaaacactcccctaaacaatcgcaaaatgatgaaccatcatgggccactgttctctttgaggggacaggtttaggggtttgcgttcgcccttgtgggctgaagcactagctttttggtagctagacacatcctgcacccaaaggttctctacaaaggcccagatttgtttgtaaagcactttgactcttacctggaggcccgctctctaagggcttcctgcgctcccacctcatctgtccctgagatgcagagcaggatggagggtctgcttctagctcagctgtttctccttgaggttgcggaggaattgaattgaatgggacagagggcaggtgctgtggccaagaagatctccgagcagcagtgacggggcaccttgctgtgtgtcctctgggcatgttaacccttctgtggggccaaaggtttgcatcgtggatccagctgtgctccagtctgtcccctcctcctccactctgactgccacgccccggaccagcagcttggggaccctccagggtactaatggggctctgttctgagatggacaaattcagtgttggaaatacatgttgtactatgcacttcccatgctcctagggttaggaatagtttcaaacatgattggcagacataacaacggcaaatactcggactggggcataggactccagagtaggaaaaagacaaaagatttggcagcctgacacaggcaacctacccctctctctccagcctctttatgaaactgtttgtttgccagtcctgccctaaggcagaagatgaattgaagatgctgtgcatgtttcctaagtccttgagcaatcatggtggtgacaattgccacaagggatatgaggccagtgccaccagagggtggtgccaagtgccacatcccttccgatccattcccctctgtatcctcggagcaccccagtttgcctttgatgtgtccgctgtgtatgttagctgaactttgatgagcaaaatttcctgagcgaaacactccaaagagataggaaaacttgccgcctcttcttttttgtcccttaatcaaactcaaataagcttaaaaaaaatccatggaagatcatggacatgtgaaatgagcatttttttcttttctttttttttttttttttttaacaaagtctgaactgaacagaacaagactttttcctcatacatctccaaattgtttaaacttactttatgagtgtttgtttagaagttcggaccaacagaaaaatgcagtcagatgtcatcttggaattggtttctaaaagagtaaggcatgtccctgcccagaaacttaggaagcatgaaataaatcaaatgtttattttccttcttatttaaaatcatgctaatgcaacagaaatagagggtttgtgccaaatgctatgaacggccctttcttaaagacaagcaagggagattgatatatgtacaatttgctctcatgttttt

SEQ ID NO: 92 - DNA, 1412 bp, Homo sapiens
ggctgcgcttccctggtcaggcacggcacgtctggccggccgccaggatgcaggccccgcacaaggagcacctgtacaagttgctggtgattggcgacctgggcgtggggaagaccagtatcatcaagcgctacgtgcaccagaacttctcctcgcactaccgggccacaatcggcgtggacttcgcgctcaaggtgctccactgggacccggagactgtggtgcgcctgcagctctgggatatcgcaggtcaagaaagatttggaaacatgacgagggtctattaccgagaagctatgggtgcatttattgtcttcgatgtcaccaggccagccacatttgaagcagtggcaaagtggaaaaatgatttggactccaagttaagtctccctaatggcaaaccggtttcagtggttttgttggccaacaaatgtgaccaggggaaggatgtgctcatgaacaatggcctcaagatggaccagttctgcaaggagcacggtttcgtaggatggtttgaaacatcagcaaaggaaaatataaacattgatgaagcctccagatgcctggtgaaacacatacttgcaaatgagtgtgacctaatggagtctattgagccggacgtcgtgaagccccatctcacatcaaccaaggttgccagctgctctggctgtgccaaatcctagtaggcacctttgctggtgtctggtaggaatgacctcattgttccacaaattgtgcctctatttttaccattttgggtaaacgtcaggatagatataccacatgtggcaagccaaagatctatgcctctgttttttcaatgagagagaaatagcaaatgttctttctatgctttcctcaccatcatcacagtgtttacaaacttttgaaaatatttagtctgttacaaacttctgtcatgtagctgaccaaaatcctgcagggccacagtcggcactgttatttgcttcttttaatcagcaaaggcctcaagtcttaaaataaaaggggagaagaacaaactagctgtcaagtcaaggactggctttcaccttgccctggtgtctttttccagatttcaatatattctctgatggcctgacaggcctattaagtagatgtgatattttcttccaagatgacctccattctcggcagacctaagagttgcctctgagttagctctttggaatcgtgaacacaggtgtgctatattgtccttgtcctaactgtcacttgccatggcctgaatgttggcttaactgaatattgtatgaaaagacatgcctccatatgtgcctttctgttagctctctttgactcaagctgtggggctcctctatacatgctatacatgtaatatatattatatatatttttgcaagtgaacaataaaacattaaaagataaaa

SEQ ID NO: 93 - DNA, 3279 bp, Homo sapiens
actgccggcctgcgcggtactcactgccggcctccgcggtacccactgccggcctccgcgctacccggccgcagcgcgcgagtcacatggaagctcctgaggagcccgcgccagtgcgcggaggcccggaggccacccttgaggtccgtgggtcgcgctgcttgcggctgtccgccttccgagaagagctgcgggcgctcttggtcctggctggccccgcgttcttggttcagctgatggtgttcctgatcagcttcataagctccgtgttctgtggccacctgggcaagctggagctggatgcagtcacgctggcaatcgcggttatcaatgtcactggtgtctcagtgggattcggcttatcttctgcctgtgacaccctcatctcccagacgtacgggagccagaacctgaagcacgtgggcgtgatcctgcagcggagtgcgctcgtcctgctcctctgctgcttcccctgctgggcgctctttctcaacacccagcacatcctgctgctcttcaggcaggacccagatgtgtccaggcttacccagacctatgtcacgatcttcattccagctcttcctgcaacctttctttatatgttacaagttaaatatttgctcaaccagggaattgtactgccccagatcgtaactggagttgcagccaaccttgtcaatgccctcgccaactatctgtttctccatcaactgcatcttggggtgataggctctgcactggcaaacttgatttcccagtacaccctggctctactcctctttctctacatcctcgggaaaaaactgcatcaagctacatggggaggctggtccctcgagtgcctgcaggactgggcctccttcctccgcctggccatccccagcatgctcatgctgtgcatggagtggtgggcctatgaggtcgggagcttcctcagtggcatcctcggcatggtggagctgggcgctcagtccatcgtgtatgaactggccatcattgtgtacatggtccctgcaggcttcagtgtggctgccagtgtccgggtaggaaacgctctgggtgctggagacatggagcaggcacggaagtcctctaccgtttccctgctgattacagtgctctttgctgtagccttcagtgtcctgctgttaagctgtaaggatcacgtggggtacatttttactaccgaccgagacatcattaatctggtggctcaggtggttccaatttatgctgtttcccacctctttgaagctcttgcttgcacgagtggtggtgttctgagggggagtggaaatcagaaggttggagccattgtgaataccattgggtactatgtggttggcctccccatcgggatcgcgctgatgtttgcaaccacacttggagtgatgggtctgtggtcagggatcatcatctgtacagtctttcaagctgtgtgttttctaggctttattattcagctaaattggaaaaaagcctgtcagcaggctcaggtacacgccaatttgaaagtaaacaacgtgcctcggagtgggaattctgctctccctcaggatccgcttcacccagggtgccctgaaaaccttgaaggaattttaacgaacgatgttggaaagacaggcgagcctcagtcagatcagcagatgcgccaagaagaacctttgccggaacatccacaggacggcgctaaattgtccaggaaacagctggtgctgcggcgagggcttctgctcctgggggtcttcttaatcttgctggtggggattttagtgagattctatgtcagaattcagtgacgtggtaggaaagaaagtcaggtcaagtgatgcttttgagcttacacacaattcacaggcccaccagtgacaatttactgtgagttaatgtcattcaggtgtgcccatggattttgagggctggaaatgcaaagacacatttttctataaaaagaaaaagcaactaaggttaaaagctatattgtggcccaagacactgtctgaaagatgacatgagtagtaattcaccactatctgaaccaagcaaggatcaatgtgctgactgcattggccaatggctttgatacttctgctatttttttagacacaaacccataaactaactgcttaagaattcatactgcttgaattatgtaaaatatattttacagtatatctttccttgggccttagattactattcactgggcaaatggtatttgtttttgttttaattttttttttaatagacggaagtcttgctctgtcatgcaggctggagtgcggtggtgcgatcatagctcactgcagcctcgaactcttgggcttcaagcaatcctcctgtgtcagccaccagagtagctgagactacaggggtatgccaccatgcccagctggcatttgttaatcttcatttgaggtctagatctaggcactgtggacactgaaaaacagttgggaaatctttcgagctgtggaaatccaaacaaagactgataattcctggtaggggtgtgtgcgtgacgtactgcagcctcaacctcctgggctcaagtgatcctcccacctcagcctcctgagtagctgagaccacaggcgtgtgccaccacgcctagctaattttttataccagggtctaccctttgtttcccaggctggtcttgaattcctgggatcaagcaatccttccaccttgccctcccaaagtgttgggattataggcatgagccaccacgactggccagaggacaaaattttaataaaggtcttagcttaagcagtaatcctacttcattaagccttcctggggtgcggtacacaccgttaattcagcaaccctcagtacatactaagtatgctcagtgctgtgaaagtggattacaccaaattaagtcattcttatcacacccaatcaaaagtcaagaagccagggataaaagcacctcaggcacataacattaatctagtaatgtaattctctgcacatccagctggtgaaactgcgtgctgtaagctgggaccagctttgtccataactgctgagagaacttgctgaagctctaggaataattttgcctgcccggttgctcaccagttgtagcttgccagctcccaacacccttcctggtgccaataaactttctcaaagagcaatactgacatttcttttgataaaacctccagccttctctgtgttgttccgacataccgaggaccaactggtctacatggatgccctgaacatgcaattctttcttccaaaataaaacattaaatagag

SEQ ID NO: 94 - DNA, 2399 bp, Homo sapiens
cccgggctcgcgggcagacggaggcgcctctctttccccgcccctcgcctcggccctttctcttcccagcacctcggctgttccccggcggcggcagcggcagcggcggcccacacagcagcgagaggcgagaggaggctgcctcgaggatgaagtgcaaacccaaccagacgcggacctacgaccccgaggggttcaagaagcgggcggcgtgcctgtgcttccggagcgaacgcgaggacgaggtcctgttagtgagtagcagccggtacccggaccgctggatcgtgccgggcgggggcatggagcccgaggaggagccgggcggtgcggcggtccgagaggtgtacgaagaagcgggagtcaaggggaagttaggccggctcctgggcgtcttcgaacagaaccaggatcgcaagcacagaacgtacgtgtatgtactgactgtcacggagctgctggaggattgggaagattcggttagcattgggaggaagcgagagtggttcaaagtcgaagatgccatcaaggttctccagtgccacaagcccgtgcacgccgaatatctggagaaactaaagctgggcggttccccaaccaatggaaactccatggccccatcctcgccagatagcgatccctaatgaacagcaaagatgttcagtattgtgctgaaagaaacattgatgtgaacccagtgatcagtggaattgtcaagtacaggtgagcacttctgtgttcccaagaagacagctcatctggtttcttcctgcatcttgggacactccttccctgtctataccactgactcttgctctggttgttgtactcttatacgtgaatagactcttaattcagcacctatagccttttgttgtgcttttttgatgtgtctgccttcattagactatgatgtctttgagagcaaagactatttttccttactctttgcatattctgcatctgagacactacttgaaatatggttggcatcactgaaggttctttgattcaattaatattttgtaatcaccgtgtggcaaaacattccccttccaatctggtgctagtagagtatatgctatctaggcaccatgtgtgtggcttttgtgtatcaggtgtttcagaaatatttcaagacagttgtaagatgtttgaggacaagaattattactcctatttctatgtcataccacacagtagctgcacagttttaagattatgccatcacctagggtaatgttttgtagaatcagtccttcgtgtaacaactctagtgtttttgtactgttgatgatttgcttaaattttattcaaaaactatcacttgctataaaggtaattgtaaaaataaatacagtggacgcaaaataatgttgtgagtttttataaaaataaattttaaaatgatatataagacatttttttgcaatgcctgccctaaccacttcttacatgtcatcttaacatctctttgaggaaacactgtttcctcattttacagatttaacatactgtattatttgatgccagagccaacaggctatatcataggcagtttccaaacttaattatgccatttagtttgtctagatttcttttgcctctctcactgatccatttggctgtagttttcatcccttttccagtacacacagctagctcctcatcctacctggtttctgcatatgagaatgcagagggctgagagagggcaaaattgttgtcatttagaaaaggcatttaggaaagaggctgctattagaggggaacacaaagtgaaggtttttttaaaaaagaggacttgcatcagctgcctccagaacaattttaagaaaataacaaagatgtttagaagaaatcttacggagtttgccatgggatgtgtgatatcagcagtcttcagctccttacaaattaccaaaagtggttctaatatgctagtttgtttgattttttcttttatattataaagcaattgcatcgataaaagcttggactccattttagtgtgacactcttcctcatgataccagtgaaatgtattgattgtgtccccagttgttacataatttgaaataaaaatataacttcttgatttattgttttttaagatgtgatatggtactgtggttatgttgttttaaaaaatgattatcttttagagaagtatactgaaaaatgtacaggtgaaatgatatgttactggtattcgcttcaaaatcatctgagtgtggggtaattgagtacatagatgaaacaagattggccataaattggtaattgctgaagctgtgtgatggatgtttgagagttcattatactattctctatacttttgtatatgtttgaaattttccataataaaaattgaaaaaagtaaaaaaaaaaaaaaaaaa

SEQ ID NO: 95 - DNA, 5490 bp, Homo sapiens
gtgggggccaggcagcacagatgaagcatttacctatctaggtaagtcaggaggagctcaaaaggagaagaaaacagtaggaggcaggggaagcagcctctgtctccatctctgccctttgaaacaaaagggtatttcttttctctcttcagcccccaacccagtggaggcccggcttgggacattgttcacttcccctcgcttcccctctagaagccccctttgccatccctgcaccttgtttcgggtgatgcccgagagggagctgtggccagcggggactggctcagaacccgtgacccgtgtcggcagctgtgacagcatgatgagcagcacctccacccgctctggatctagtgatagcagctacgacttcctgtccactgaagagaaggagtgtctgctcttcctggaggagaccattggctcactggacacggaggctgacagcggactgtccactgacgagtctgagccagccacaactcccagaggtttccgagcactgcccataacccaacccactccccggggaggtccagaggagaccatcactcagcaaggacgaacgccaaggacagtaactgagtccagctcatcccaccctcctgagccccagggcctaggcctcaggtctggctcctacagcctccctaggaatatccacattgccagaagccagaacttcaggaaaagcaccacccaggctagcagtcacaaccctggagaaccggggaggcttgcgccagagcctgagaaagaacaggtcagccagagcagccaacccaggcaggcacctgccagcccccaggaggctgcccttgacttggacgtggtgctcatccctccgccagaagctttccgggacacccagccagagcagtgtagggaagccagcctgcccgaggggccaggacagcagggccacacaccccagctccacacaccatccagctcccaggaaagagagcagactccttcagaagccatgtcccaaaaagccaaggaaacagtctcaaccaggtacacacaaccccagcctcctcctgcagggttgcctcagaatgcaagagctgaagatgctcccctctcatcaggggaggacccaaacagccgactagctcccctcacaacccctaagccccggaagctgccacctaatattgttctgaagagcagccgaagcagtttccacagtgacccccagcactggctgtcccgccacactgaggctgcccctggagattctggcctgatctcctgttcactgcaagagcagagaaaagcacgtaaagaagctctagagaagctggggctaccccaggatcaagatgagcctggactccacttaagtaagcccaccagctccatcagacccaaggagacacgggcccagcatctgtccccagctccaggtctggctcagcctgcagctccagcccaggcctcagcagctattcctgctgctgggaaggctctggctcaagctccggctccagctccaggtccagctcagggacctttgccaatgaagtctccagctccaggcaatgttgcagctagcaaatctatgccaattcctatccctaaggccccaagggcaaacagtgccctgactccaccgaagccagagtcagggctgactctccaggagagcaacacccctggcctgagacagatgaacttcaagtccaacactctggagcgctcaggcgtgggactgagcagctacctttcaactgagaaagatgccagccccaaaaccagcacttctctgggaaagggctccttcttggacaagatctcgcccagtgtcttacgtaattctcggccccgcccggcctccctgggcacggggaaagattttgcaggtatccaggtaggcaagctggctgacctggagcaggagcagagctccaagcgcctgtcctaccaaggacagagccgtgacaagcttcctcgccccccctgtgtcagtgtcaagatctccccaaagggtgtccccaatgaacacagaagggaggccctgaagaagctgggactgttgaaggagtagactctgcgaccagtacagaccctgtcctggctgaacaagaagagacacatgctccacttgggagcctttgccaccacgcaactcagggctcaagatgaatgggagggagagatttgagtccaagcatacatttatattcagtgttgtgccattgagttcccatgtggatcattctgaaggtgatctccacaagagggtgtgtgtgtgtgtgtttggtgtgtgtgtggagggggggccgctggatacatcactgaagctattgatataacacaatgagtcactgttcagaattttgctcttgttagatgttttcttacattgggtagagtccagcctagtgagagctgagtgaaggggctggccatgcctgagacaaaaagtcaaatgagacaatggacgtgtcaatgacttgaaaaaaagtcacatccagcaaatgcagggtcacatgaaatatgggcctcctggaatccctacagtggatggagactggctcataccttgccagatccctctctcagttccagccttctggacaaggcctgggctaagaggagctgattcgttatctcttcacccactgccctctcagtatcaccagtcccaaagacaggatacgtccctgtaacccaatctctcggttgattgatagcagaacagctcttgttggtctgagaaggcaggataagtgaccacatatttatgccactacctccaccagggagagtccttctccacaggcttgataaattcaatcaccaactgtgctgtcgtccctgactctgctactcccgttcttcctgctttcctgctccgtatctcagtctgcactgaccccagggctgggctgacatcaagatgggagcccagcccacgggctttataaacacccaagaaccgtttcagatcttctctgtgctgatgcaggtagttttaaatttttctcagttccagtgatagaaaacccacacaatacatcctctgccagtcttaatagaatatcagaggtaagaggggcctcagagaagctctgacgcagtgctgctggggaagggaagtgactaaccccgggtcagcctgccatttagggaaagagctgaggttcttacccttgttgcatgctgccacctctccttagccagtgctcttgtacatccacacagcaccctaaggagccatagtcaccatcaaagactcaaccctaaggcccttcaagatctcaaagtgccttctgaagcatcagagattaaatattgttcaaactaatagttattgctgtggcttttaattttatctttggaagatagctatatggtaactcatcattaaccagaacacctctcccctcaaattccgtgaccaagttgtgcagcttgagcaaatgccgaaagagggtattatgggtgggtggtgtgggcttgcaaatacaagcttggaggtgagacatggccagacatgactcctgcttccccttaggaagtaaatcttacttatggttgtgaactgcttggagtccaggatgcccagatgtgaggggcagatgaagggaatgttgctggaaaggtgccttttaaggctgctgagaatttctggactgtgtcctgatggacgcagcaccatcaaagcccagaatttctgaaaacggtgacaaggttaacataaggacaacaaatactccaccctgtcatggtatgtgaggtgtgggtgtggcggtttctgtgtacgtttgctcatacacgcacatccaaaagcctgtgcctcattcctggccatgggtgaggacttggtctgtcacggctgatgaggactcccacaaccggccaagttatgtcttattatacacccccagaaagagagaaagctgccttctggaggactgattccacatgctatattcagctgagttgatttctgtgtctatttcaacccataacctgaagaatgatcaccttattccttattcattaattttcttgattaatagggaaacttgggaatagctataaagtaaaacttgggtggaacctggggccctggcatcacacaagtgtgattaggatggtcaaggtcatcaggagtacagcctattatattcccacatcctgagaaaggtcatttctcccacacacgacaaagtcacagacatcctgcacctgccactaggcatcctcatcctactgacatgcccatttctccagttttcttaatctgagactcccttcccttgttttttaaagataccgtgcttctccacatcctcatccttcaaggagcatattttgctcttaggatggtctttgggattcaagaatagaataataaatccaaacttggtcattcccattttgaagagatgcaagagggcccagtgaggacatccgcctccctgaaagtggtgctagacagagctgaggtcattgtatctgtgtatccacataggatttctcttaattcagcttgaattgatggggagggaggtaagagtagggtcagagttactcatcccttttcaaagaattgtgggtggaagtttgtaaaggccattcatttgattttcaaaatcaaagcgacagctctacttccacttggccttagatctctgctataccctgccatagccttgatgccactgggcacaagccacctgccaaatacaggagtggcctctcccagcctggcatgataggggggtctgtgccctcagatgtgttgacagctgctcttctgaattgccacacctgtgctacacttggaattctgtgctctgactctgcagggtaggaccacgtgccatctcacacagaggtcaaccgatgagcccactcactcgtacatgccttcttccacagtgggaagcatgatctggcaggggccgccctgtaggctggggatgggctgctgtgtgaatgttgacgttcgtttcatggagaaaggggaggtgaaagattgaagagcaggttcctgtcaatgttctgagttcgagctggaggtgtagattgaatagtctacatggtctgtgagtgtgtgagatgaacccttccatcctttgacacctggttgtatgtgtaggctaagaaggaaggaccctcctgtcagtgtgcaaagctgtaatctcatggactagaggagagggggccaaggggatggacaggagaagtcatgcagaatctaagcaggaatgcagatagaacacatctaggctcttttccccaggagagtgatgatggagcatatagatctggctcaaattcagcctccatcacttaccagtcaggaaccctggcgatatcactttaactttctgaacctcagagtcttcacctataagacggggaaaataataccaccctttcaagattgttgagataaataagtgatataaaacatgtaaagcttagttctggccacagtgtagctactcaataaatgataatact

SEQ ID NO: 96 - DNA, 4320 bp, Homo sapiens
acagatcaacagtacaaattctgaagtttgtaaacttgctgatggtggtggtaagccatggcagatgataaagttgctatcttaacggatgatgaagaggaacagaagagaaagtatgtgcttgcagatccctttaatggtatttccagggaaccagaaccaccttcgaatgaaacaccttcctccacagaaacatctgctattcctgaggaggaaatagactggatagagaaacattgtgttaagataaacaacgatcttctaatttccaaggtcttttattttttcttttactctgcctatggctctctctatccccttttgcctgtgtattacaaacagctgggaatgtctccaagccagagtggactactagtaggtattcgttacttcattgaattctgcagtgcccccttttggggtgtagttgcagaccgctttaaaaaaggcaaaattgtcctcctcttttctcttttgtgttgggttttattcaacctgggcattggatttgtcaaacctgctaccttgagatgtgtaccaaagattcgcccaacaactcaccccaccaatgcaagtcaccagttaactatcctgccaacaaattcttcctttacctctttcctcaccatatcaccaaaaatgcgtgagaaaagaaaccttttggaaacagggctcaatgtctcagacaccgttactttgccaacagctccaaacatgaacagtgaacccactctgcagccccagacaggtgaaattactaaccgtatgatggacttgactttgaactcaagcacagcaacccctgtctccccaggaagcgtaaccaaggagacaaccactgttattgttaccaccaccaaatctttaccttctgaccaagtcatgcttgtttatgatcaacaagaagttgaagctatattcttggtgatcttggtagttgtcataataggagaatttttcagtgcctcttctgtcacaatcgtagacacggtcacactccagtatctgggaaaacacagagatcgctatgggttgcagcgcatgtggggctccctgggctggggcctggcgatgctgtctgtgggcatcgggatcgactacacccacatcgaagtgctcatcgatggaaaggggtgtaagccccccgagtacaggaattaccagatcgtcttcatcgtcttcggcgttctcatgaccatggccttgatcgttgccactcagttccggttccgctacaaccatttcaaaaacgatgattctaaagggaaagaggtggagatcccgcaggtggaaaggaacaactctacagagtcctctgaggagacaccaaccaccacaagccactcgcaggccttcaacttttgggacttaatcaagctgctctgcagcgtgcagtatggctcagtgctgtttgtggcttggttcatgggttttggatatggcttcgtgttcacctttctctactggcatttggaagacctcaatggaactacaaccctctttggggtctgttcagtcctgagtcatgtgtctgagctgacagcatatttttttagtcacaagcttattgaattgatcggccacatcagggttctgtacattggcctggcctgcaatacggctcgctatatttatatttcctacctggagaatgcctggactgttctccccatggaagttcttcaaggagtgacacacgcggccatctgggcagcatgcatttcttacctcagtgcagccgttccccctgagctgaggacatctgctcagggcatcctgcagggccttcacctgggtttgggaagaggatgtggtgccatgatcggaggcgtgttagtcaattattttggggctgctgcaaccttccgaggaattggcatggcctgcttggtgatcctactgctctttgccctgatccagtggctggcagtgccagatgaggaagaagacaagacaatgttggcagaaagaattcctgttccctccagtcccgttcctatagcaaccatcgacttggtacagcaacagacagaagatgtcatgccacgcattgagcccagacttccacccaagaaaactaagcaccaggaagaacaggaagatgtgaacaaaccagcctggggagtcagctcttctccctgggtgacctttgtctatgcactctaccaaattaaagagatgatgcaactcacaagagacaaccgtgcttctgagatacagcctttacaggggaccaatgagaatagggaaaattctcctgctggtagagcccagcctgtcccatgtgagactcactctgacccatctagaaaccagccatcccctgacgcagcagcatctcagacgcagaccagccccgctcaccccagtgtggacccgtgcacagaggagagtgaagagcagcaggctcagctggccgcgggaggacactgagggcatcctgctcatctcacaccctgcatggaatcaggctcctcagccaggacacagggtgaggccccccagccaggatatgcctcccctggaggagcacagcactgcatatgcttctaaatatctaaactcattaacatggaaacacacacacaggagctacagtacatattggcaggaaaaggtaaactttcgtaatctcattggaattacaacagggaaatggagttcaatgaggactttcagttctttgcttggttaggttaaggatgatagaatttctctgccagtgcagtaagagttgaaaccggcagttacactaagtaagtggagggaatgaaagtgtttcgaggtgaatgtggatataatttccctcttctgattatttattcttatttggttcctaacacaaactgggaagagatagaattcatctatactttcttttttcttggagagaaccgtttaaaaaattacaagatatatttaaaaagtaaccagataaaagtagcacatgtgcttttgttaaaaataaagttaaaagttaaagttaaaaaatgaagttaaaagtttcatcagaaactttacatatctttagcaaatatatttttatatgtgtatggcatataatggaaataattctttgagcaacagaagctattattaactactgcaagctaagccgagcttaaaaatgccttttgttttaaatgggctttgagaaaaaaaacagaaacaagcgattatttcaaatcaaccaaccaactcagtatcctgtgttttgatagacaagagtttactaaatatattgatactgtaaatagcctctctcgctatttactatcttatagtaattcaggctctaattagctgagggaatgaaacacacaaaaatcactgaattcctaagagttccttaaataagcagtactagttacaaatcacagtataagatttaagtgcctgggggaaggatacaatttttagaaattacatattgggtcagttttgttttgtttttggtgaggaaaaggtggtaaataggaaaccatgaatgggaaggatggcaataagtagcaactatactttccaatgactaaagaaagaaaatctcagtatattcgttctcatgaagacacagtcagacactggacaatgtaatgtatgcaactgcaaacgttacaactgcagccagaacaatggctgggtggatcgcacgtaaagcttgccactaaaaatcaaagcagaggttaacaggaaacctggggggagtgtggaaaagggaaaactgttttagctgaataaaggtgaattatataatttataatagctgtggatgagcacaggagagagaggaaagaaaagaacagtcgaaatgagcaactcaccttaccctctgaccctgattagacaggatcaattgtaaagtgagggcttctccatgacaccatagttctgcccaatactgcatttgggataagaaattctacacttggatgtctcgcttcacaataaaacacagcttaaaaataaaataactgaaagaaatagaattcagcaaatagttattttttgcacttgaactgaaacgtactgtactgtaaattatgactcattttaagtgacctttaaaatcagatgtatttattatgcttgtgtaattatagaaataaagaaatgggtgacaggcttaacctcacctatgaatgtacagtatgtggatttgtgaaactgactgtaggaagtcaaaaacttgtactgtatcttgtgtttacagttctgatttattcctttgaaaagcctgctgttttggaaatgcacagttgacatgttgaaataaaaatgaataccatttttaaaaaaaaaaaaaaaaaaaaaaaaaaaaaa

SEQ ID NO: 97 - DNA, 1498 bp, Homo sapiens
ttacattagcaagagagcaagttgttccagtagttgcctggcaggagaatttgaaagggtgccccaaaggacaatctctaaaggggtaagggagatacctaccttgtctggtaggggagatgtttcgttttcatgctttaccagaaaatccacttccctgctgaccttagtttcaaagcttattcttaattagagacaagaaacctgtttcaacttgaagacaccgtatgaggtgaatggacagccagccaccacaatgaaagaaatcaaaccaggaataacctatgctgaacccacgcctcaatcgtccccaagtgtttcctgacacgcatctttgcttacagtgcatcacaactgaagaatggggttcaacttgacgcttgcaaaattaccaaataacgagctgcacggccaagagagtcacaattcaggcaacaggagcgacgggccaggaaagaacaccacccttcacaatgaatttgacacaattgtcttgccggtgctttatctcattatatttgtggcaagcatcttgctgaatggtttagcagtgtggatcttcttccacattaggaataaaaccagcttcatattctatctcaaaaacatagtggttgcagacctcataatgacgctgacatttccatttcgaatagtccatgatgcaggatttggaccttggtacttcaagtttattctctgcagatacacttcagttttgttttatgcaaacatgtatacttccatcgtgttccttgggctgataagcattgatcgctatctgaaggtggtcaagccatttggggactctcggatgtacaacataaccttcacgaaggttttatctgtttgtgtttgggtgatcatggctgttttgtctttgccaaacatcatcctgacaaatggtcagccaacagaggacaatatccatgactgctcaaaacttaaaagtcctttgggggtcaaatggcatacggcagtcacctatgtgaacagctgcttgtttgtggccgtgctggtgattctgatcggatgttacatagccatatccaggtacatccacaaatccagcaggcaattcataagtcagtcaagccgaaagcgaaaacataaccagagcatcagggttgttgtggctgtgttttttacctgctttctaccatatcacttgtgcagaattccttttacttttagtcacttagacaggcttttagatgaatctgcacaaaaaatcctatattactgcaaagaaattacacttttcttgtctgcgtgtaatgtttgcctggatccaataatttactttttcatgtgtaggtcattttcaagaaggctgttcaaaaaatcaaatatcagaaccaggagtgaaagcatcagatcactgcaaagtgtgagaagatcggaagttcgcatatattatgattatactgatgtgtaggccttttattgtttgttggaatcgatatgtacaaagtgtaaataaatgtttcttttcatt

SEQ ID NO: 98 - DNA, 2045 bp, Homo sapiens
gagattctgtgccccttgtcgggccgcttgtttggctgctgccgtcacctcatggcgacgcgggtagaggaggcagcgcggggaagaggcggcggcgccgaagaggcgactgaggccggacggggcggacggcgacgcagcccgcggcagaagtttgaaattggcacaatggaagaagctggaatttgtgggctaggggtgaaagcagatatgttgtgtaactctcaatcaaatgatattcttcaacatcaaggctcaaattgtggtggcacaagtaacaagcattcattggaagaggatgaaggcagtgactttataacagagaacaggaatttggtgagcccagcatactgcacgcaagaatcaagagaggaaatccctgggggagaagctcgaacagatccccctgatggtcagcaagattcagagtgcaacaggaacaaagaaaaaactttaggaaaagaagttttattactgatgcaagccctaaacaccctttcaaccccagaggagaagctggcagctctctgtaagaaatatgctgatcttctggaggagagcaggagtgttcagaagcaaatgaagatcctgcagaagaagcaagcccagattgtgaaagagaaagttcacttgcagagtgaacatagcaaggctatcttggcaagaagcaagctagaatctctttgcagagaacttcagcgtcacaataagacgttaaaggaggaaaatatgcagcaggcacgagaggaagaagaacgacgtaaagaagcaactgcacatttccagattaccttagatgaaattcaagcccagctggagcagcatgacatccacaacgccaaactccgacaggaaaacattgagctgggggagaagctaaagaagctcatcgaacagtacgcactgagggaagagcacattgataaggtgttcaaacgtaaggaactgcaacagcagctcgtggatgccaaactgcagcaaacgacacaactgataaaagaagctgatgaaaaacatcagagagagagagagtttttattaaaagaagcgacagaatcgaggcacaaatacgaacaaatgaaacagcaggaagtacaactaaaacagcagctttctctttatatggataagtttgaagaattccagactaccatggcaaaaagcaatgaactgtttacaaccttcagacaggaaatggaaaagatgacaaagaaaattaaaaaactggaaaaagaaacaataatttggcgtaccaaatgggaaaacaataataaagcacttctgcaaatggctgaagagaaaacagtccgtgataaagagtacaaggcccttcaaataaaactggaacggttagagaagctgtgcagggctcttcaaacagaaaggaatgagctcaatgagaaggtggaagtcctgaaagagcaggtatccatcaaagcggccatcaaagcggcgaacagggatttagcaacacctgtgatgcagccctgtactgccctggattctcacaaggagctgaacacttcctcgaaaagagccctgggagcgcacctggaggctgagcccaagagtcagagaagcgctgtgcaaaagcccccgtccacaggctctgctccggccatcgagtcggttgactaagatgaggtgtgatcactgtattgagagatatattttgtgtataactttctctgttagtagttaactattggttttgtggtgaaaattttcttactttttctaccatatctgtattttcttagaactactggacttatgtggtacaggaggctgcttagcagttttgaatagtttaatctataaattttcctcagctgtgttgcacatcagcctcgttctccctccactggaatgcatgtgttcactgccttgtcctttctctccctgctccttgcacattatcatcctaatgaaaatttcactgacagggccgaccattacaagggaactttgttctgacgatggttccttgatgtgaaaacaatattaatttaaacgtcttagcccccccccccataatattattc

SEQ ID NO: 99 - DNA, 1796 bp, Homo sapiens
ctgggctcgggtgatcctcctgtcttagccttccaaggtgctgggattacaggtgtgggccaccatgcccagccaccatcttggtttaatttctttccttggaaatggagcaaagggctttcactcttctttttcatggctgcatagtattccataattgtttaaacaattgataatagacactgtatcggggtgactggtatacccccaaaatcacatctgcccagagcctcaggacatggccttgtttggaaatggttttagcagatgcagctaagatgaggtcaccccgtgttaggatggccccgaatccagtgcctggcacccttataaggagagggaaacttggacgcagacaggaaggccgggtgaagacagaagcagagaccgggggccaaggagtgcctggggttgcccagagccaccacgggctgcaagaggtgtgggacagactctctcagccacagaagggcccagccccgcacaggcctggatttcagagggcgaacatttctgtggccgaagctcccagtgcgtttgcagtccttggagacggccgcagacacatttgttcttggcctgtctccaggtctgtagcccccacagtgagcggccactggccggaggggaacaggaagagctggaggggacgtcacacacatgagccttttaggaataacgagtgacacgtgcaagaccccaaaccaaacaccatgtaacctgacacccagggagggagggagggaggggctgggaggggctcacctgtagggaggggctcacctgtacagcggtgctgggaagctggcctcgagggtccccgaggggatacagggccgtgcagcctcttgcctgagggtttgcatgtctgcctggatcccccgggctcctgccagaaggcctctgaggccaccgttgacagcataaaggccacccagtgtctcggcaaccacgctgaccactccctcctcccagctgcggggtgaggtggcctcgagggaagggctggagagtcgttctgagtatttaacaactgggggtgacacagtgtgggtgggcaaggccagggccactgccaggtggggtccgtggccctgagcccccagctctatgcaccccccacctggggtctggcttctccatctccacacccccttgaggggcttctgtctccccctgccccttcgatcgcaggaggcagtgcctggccggggtcgcaggcacctgtcaccccagctcctcactcctcacccactcacatccagtccgtttgtaaaatacacccaggatgagacctgcacgcaagtggctcacagcagcacgatttgtgacagcccgaggcggagaacaccgaacacccagtgaaggtgaggggatcagcacggcgcggccacccacgcacccacgcgctggaatgagactcagccacaaggaggtgcgaagctctgacccaggccacagtgcggatgcaccttgaggatgtcacgctcagtgagagacaccagacacagaagggtacgctgtgatcccacttctatgaaatgtccaggacagaccaatccacagaatcagggagaggattcgtgggtgccgggactggggagggggacctgggggtgactaggtgacataatggggacagggctgccttctgggtgatgagaatgttctggaatcagatgggatggctgcacggcgtggtgaaggtactgaacgccacctcactgtaagacggtagattttgtattttaccacaataaacaaaacaaaacaaaaccaaaaaaaaaaaaaaaaaa

SEQ ID NO: 100 - DNA, 2943 bp, Homo sapiens
gtgctgcctggcgctggctaggaggcaaacgcacgcgggaagagctgctacccattccagggaccctgccgctgcccctctgaggggtctgcacctcctgggagcaggtgggtctctgggacgagggtccatggtggatggctctggagacgctcccgaggctgtgccgtcccgctgctgcacaggtcggagggtcaccgcagaggctactcgggctggggctggggccgagggagcccgcactggagccccatgtggaacccaaggatgcagctgctctgctaacacggcagcccatccttcgagactgtgacctcgccacagtggccctcagccctccacctccggcgggggcgagggccacccacctccaagtctccagccatgacgacctccgcactccggcgccaggtgaagaacatcgtgcacaactactccgaggcagaaatcaaggtgcgcgaggccaccagcaatgacccctggggcccccctagttcgctcatgtccgagatcgctgacctgaccttcaacacagtggccttcaccgaagtcatgggcatgctgtggcggcggctcaatgacagcggcaagaactggcggcacgtgtacaaggctctaacattgctggactacctgctcaagacgggctccgagcgggtggcccaccagtgccgcgagaacctctacaccatccagacactcaaggacttccagtacatcgaccgcgacggcaaggaccagggcgtcaacgtgcgcgagaaggtcaagcaggtgatggccctgctcaaggatgaggagcggctgcggcaggagcgaacccacgccctcaagaccaaggagcgcatggcactggagggcatcggcattggcagtgggcagctgggcttcagccgccgctacggcgaggactacagccgctcccggggctccccgtcctcctacaactcctcctcttcgtcaccccgctatacctccgacctggagcaggcccggcctcagacgtcaggggaagaggaactgcagctgcagctggccctcgccatgagccgtgaggaggcagagaagcctgtccccccagcctcccacagggacgaggacctgcagctgcagctggctctgcgcctgagccggcaggagcacgagaaggaggtgaggtcctggcagggtgatggctcccccatggccaatggtgcaggggccgtggtccaccatcagcgggacagagagcctgagagagaggagagaaaggaggaggagaagctaaaaaccagccagtcctccatcctggacttggctgacatcttcgtacctgccctggccccgccctccacacactgctctgctgacccatgggacatcccaggttttaggccgaacacagaggccagtggatcctcctgggggccttctgcagacccctggtctccgatcccctcaggaaccgtcctgtcccgaagccagccctgggatctgactcccatgctctcctcctctgagccctggggcaggaccccagtgctgcctgctgggccccccaccacagacccctgggccctgaactctccccactacaaactccccagcactggggctgacccttggggagcctccctggagacctccgacacacctggtggtgcctcgacctttgacccatttgccaaacctccagaatccacagagaccaaggaggggctggagcaggccctgccctctgggaagcccagcagccctgtggagctggacctgtttggagaccccagccccagttccaagcaaaatggcacgaaggagccagatgccctggacctgggcatactaggggaagcactaacccagccaagcaaagaggcccgagcttgccggactcccgagtccttcctgggtccctcagcttcctccttggtcaaccttgactcgttggtcaaggcaccccaggttgcaaagacccggaaccccttcctgacaggtctcagcgctccgtcccccaccaacccgttcggcgcgggcgagacgggcaggccgacgctaaaccagatgcgcaccggctcgccggcgctgggcctggcaggcgggcctgtgggggcgcccctgggctccatgacctacagcgcctctctgcccctcccgctcagcagcgtgccagctggcttgaccctccccgcctcggttagcgtcttcccgcaggccggagccttcgcaccgcagccgctgctgcccacgccgagctcagccgggccgcggcccccgcccccgcagaccggcaccaaccccttcctctgagccccgccccgtcccataccggcctgcgcctgcgccggacgctccgcggccccgcctccggacccggggctgggcggggcgccggtgctagtggaacgccgtgccagtggcggctggtatcccgcggcggctctggaagctggacgcggaccacggcccgggagctagaaactgaacgcccgcataataaagactggaacccacgttctcagctctcaccaagtggactttttgcggggtgtggcggccgggtctcgaccacagcgtggatcaccggctgtttaggaaactgcagctgcacaacgtggggtgcaaaactgccccgcttcctttacagctcttctcaaccctcacctccatcccccgtcacccaggcaccttcgcttccagatgctgccaggctgtcactcaattcggtcatttcattcatttatcacacatgggcactggggttgggctaacagcaagagacaataggcctttgttcctatttattgggtactgcttacgtgctaagcagatcagtttatttaatgcttgcaacgactctctgaggtagaaaatattgttaattccgttcaggatcccggctacataatctgtggggctcaatacaaaataaaaatgtaggggctccttgttcaaaaaaaaaaaaaaaaa

SEQ ID NO: 101 - DNA, 5879 bp, Homo sapiens
cgccagggctgcgtaggcttgtggcgcgcccgcggagaggccggggctctgacgcccgctctgcggcttcggtgtttgaacaggccacagtccaggagcgcttacattcaggagctccgcgtagcacctgcccaaccaaactcagccctccgttaagatcctggttccatgccgcagtaggacagcaggcccaagtctgcacatcccagtgatgcaccatgccaatagtggataagttgaaggaggccctgaaacccggccgcaaggactcggctgatgatggagaactggggaagcttcttgcctcctctgccaagaaggtccttttacagaaaatcgagttcgagccagccagcaagagcttctcctaccagctggaggccttaaagagcaaatatgtgttgctcaaccccaaaacagagggagctagtcgccacaagagtggagatgacccaccggccaggagacagggcagtgagcacacgtatgagagctgtggtgacggagtcccagccccgcagaaagtgcttttccccacggagcgactgtctctgaggtgggagcgggtcttccgcgtgggcgcaggactccacaaccttggcaacacctgctttctcaatgccaccatccagtgcttgacctacacaccacctctagccaactacctgctctccaaggagcatgctcgcagctgccaccagggaagcttctgcatgctgtgtgtcatgcagaaccacattgtccaggccttcgccaacagcggcaacgccatcaagcccgtctccttcatccgagacctgaaaaagatcgcccgacacttccgctttgggaaccaggaggacgcgcatgagttcctgcggtacaccatcgacgccatgcagaaagcctgcctgaatggctgtgccaagttggatcgtcaaacgcaggctactaccttggtccatcaaatttttggagggtatctcagatcacgcgtgaagtgctccgtgtgcaagagcgtctcggacacctacgacccctacttggacgtcgcgctggagatccggcaagctgcgaatattgtgcgtgctctggaactttttgtgaaagcagatgtcctgagtggagagaatgcctacatgtgtgctaaatgcaagaagaaggttccagccagcaagcgcttcaccatccacagaacatccaacgtcttaaccctttccctcaagcgttttgccaacttcagcggggggaagatcaccaaggatgtaggctatccggaattcctcaacatacgtccgtatatgtcccagaataatggtgatcctgtcatgtatggactctatgctgtcctggtgcactcgggctacagctgccatgccgggcactattactgctacgtgaaggcaagcaatggacagtggtaccagatgaatgattccttggtccattccagcaacgtcaaggtggttctgaaccagcaggcctacgtgctgttctatctgcgaattccaggctctaagaaaagtcccgagggcctcatctccaggacaggctcctcctcccttcccggccgcccgagtgtgattccagatcactccaagaagaacatcggcaatgggattatttcctccccactgactggaaagcgacaagactctgggacgatgaagaagccgcacaccactgaagagattggtgtgcccatatccaggaatggctccaccctgggcctgaagtcccagaacggctgcattcctccaaagctgccctcggggtccccttcccccaaactctcccagacacccacacacatgccaaccatcctagacgaccctggaaagaaggtgaagaagccagctcctccacagcacttttcccccagaactgctcaggggctgcctgggaccagcaactcgaatagcagcagatctgggagccaaaggcagggctcctgggacagcagggatgttgtcctctctacctcacctaagctcctggctacagccactgccaacgggcatgggctgaaggggaacgacgagagcgctggcctcgacaggaggggctccagcagctccagcccagagcactcggccagcagcgactccaccaaggccccccagacccccaggagtggagcggcccatctctgcgattctcaggaaacgaactgttccaccgctggccactccaaaacgccgccaagtggagcagattctaagacggtgaagctgaagtcccctgtcctgagcaacaccaccactgagcctgcaagcaccatgtctcctccaccagccaaaaaactggccctttctgccaagaaggccagcaccctgtggagggcgaccggcaatgacctccgtccacctcccccctcaccatcctccgacctcacccaccccatgaaaacctctcaccccgtcgttgcctccacttggcccgtccatagagccagggctgtgtcacctgctccccaatcatccagccgcctgcaaccccccttcagcccccaccccacattgctgtccagtacccccaagcccccagggacgtcagaaccacggagctgctcctccatctcgacggcgctgcctcaggtcaacgaggaccttgtgtcccttccacaccagttgccagaggccagtgagcccccccggagcccctctgagaagaggaaaaagacctttgtgggagagccgcagaggctgggctcagagacgtgcctcccacagcacatcagggaggccactgcggctccccacgggaagaggaagaggaagaagaagaagcgcccggaggacacagctgccagcgccctgcaggaggggcagacacagagacagcctgggagccccatgtacaggagggagggccaggcacagctgcccgctgtcagacggcaggaagatggcacacagccacaggtgaatggccagcaggtgggatgtgttacggacggccaccacgcgagcagcaggaagcggaggaggaaaggagcagaaggtcttggtgaagaaggcggcctgcaccaggacccacttcggcacagctgctctcccatgggtgatggtgatccagaggccatggaagagtctccaaggaaaaagaaaaaaagaaagcaggagacacagcgggcagtagaagaggatgggcatctcaaatgcccaaggagtgccaagccccaagatgctgttgtccccgagtccagcagctgcgcaccatccgcgaatggctggtgtcctggggaccgcatggggctgagccaggcccctcctgtgtcttggaatggagagcgggagtctgatgtggtccaggaactgctcaaatactcatctgataaagcttacgggagaaaagttctgacctgggatggcaagatgtcggcggtcagtcaggatgctattgaagacagcagacaggcccggactgagaccgtggttgatgactgggacgaagagtttgaccgagggaaggaaaagaaaattaaaaaatttaagagagagaagaggagaaacttcaacgccttccagaaacttcagactcgacggaacttctggtctgtgactcacccagcaaaggctgccagcctcagctatcgccgctgactgtgcccctgtggaaggaggtcggttccgagggggtgggtgtaagggtgaggtgggggtgtgtgtgccgtgtatgtgtgtaggggtgtggtggggtgtggcgtgtgtgtatgatgtatgtgggctgtgtatctggcacatgtgtgttgggtggtgtgtgtggtgtgggcgcgtctgtggtgtgtgtcctagtcacttggagaagggtgtgtgtgggatgcgtgtgtataagggggtgtgtgtgggatgcgtgtgtataagggggtgtgtgtagtgtgtgttgggtgtggggtgtgtacacctggcatctgtggcatgtgttctggtcacttggagaagggcatgtgtggggtgtgtgtgggatgtgggttgtgtgtatatctggcatgtgtcccagtcacttgcagaagggtgacttcttgccagccgcatcgagatgccatgcattgggttcctaggttggactcatacccgagggtggcagtgggaagattcgggtctcgtttctctctgtcaggactaccgtggtttgttctgcagcctcctggagacaaggcgtcccttcccgggagctgtcggtctggatctgagggagctctctgtgtgggctctgctgtgctgggagcctgtcacggtaggagctctcccggtaccagtgtccacagaccgcccaacatagaggctttgaggcttctctagatcggaacctctttggtgacattcccgaccagccctgcaagagaaacgacagtgtgtgtgtgagcagaggtggctgcacacctgctggacatctttgccaggctgtgccttctcatgtttcatagacagtggtctgtgctggcagaggctgctgcccctggttggggctatcaggagagtgggggatggtggccacatgtcctccaggtggtctcccggtgcatagctggtggctctgggcaagccatcccttgcttctcggggctgacgccaccgttgtgtccgagcccgccctcccctgcttcctcagcgggaccccttcatctgttggccttacctgtcctcagaaaggaagaggtgaccccacccagccacctctcccttttatggaactcgagagggtggccctactgtgcaccccttccttgtgagtagctctcaactgtcctggagagcagaggctatttggggtcggaggagccctcgatacctgcgaatacatctgctttccaggctgctgtttattctgagacgactgtgctgtagcttcccttgcagctgcaataacccgcaggtcttcactgaggtggaggctttggggtagaattctccatttattttactacttaatacaaaacatttatttttgaccagtcctgtggcttccattagcaatatgtttcctttcccaaatatgcaaatagtggctttgtttgctcaattttgtgagtgctttggaatttaaatgattgtataactcaagaagattacttttctatgttgctcaagctgtgcctgccaacttgtaacttaataaatacaggaaatcctcagagaaggtgatattttcaggaaaaagacaaatgccctcatagtagtgggaagtgtgaaggtgaccgtgaacatccttcctcatcgggtctgtccccgtcatttcctcccggagtcgtcgcaggtggagatggacaacgtggtgttggacttagacctccttcagtgtggctctgctgggccagaggcatcctgctgtcccgggtggctgcctcgctgtctgcaccccctctccctggggcagctttgcttcctgcccctgtgctcggggcctgggtggttactggcgtgtagatggaattgcttttttaatatgggaagatacatttatttttttccatgtgggtgggtgtctctttttggattttcttctgtttttacgtttctcttcttagaagggtgggagagaatcaagctcctgtggccacctgtgtcccagcagcagtgagtggagctgctcagggtgccctctcctgcggaccagtctctgaatgttcaaagatgagggcctggcttccgtgctctggctttgtaacttatctggaagggaaagcacatgccttcacgggcaggatgatcaagcggtgctgattcacgagagtggaagcctccagagcttggggctttctggctgctcttcattgacctgtgtgttcccagcacacgaacagcgcccctaacggagatttgttcagcgactgaatatacacctgtaaacgagtagcatgtatacattgattttgattacaaatggttctgtattat

SEQ ID NO: 102 - DNA, 1889 bp, Homo sapiens
ccgggtggatggagttggaggggcggggtgctggcggtgtggcgggggggcaggcggcagggcccgggcggagccccggggagtcggcgctgctggacgggtggctgcagcggggcgtgggccggggggccggcggcggggaggccggggcctgcaggcccccggtacgacaagatccggactccggcccggactacgaggcgctgccggctggagccactgtcaccacgcacatggtggcaggcgccgtggcagggatcctggagcactgcgtgatgtaccccatcgactgcgtcaagacccggatgcagagtctacagcctgacccagctgcccgctatcgcaatgtgttggaggccctctggaggattataagaacggagggcctatggaggcccatgagggggctgaacgtcacagcaacaggcgcagggcctgcccacgccctttattttgcctgctacgaaaagttaaaaaagacattgagtgatgtaatccaccctgggggcaatagccatattgccaatggtattgagccttcctgtgctggttcccccactttcccaactctttgggctttgctgctgtcagtgctttccagtctcagcatggtttggagctgaagctttgggctgggataggccactggtggcaggtgatgtgctggcatccctaggcagcagtgtatctgcttcctgtctggggtgtgagctgcatttattctcagaatgatctttattgataagacttgagctggccttcctatcatggatgtggaatacattagtgaccttacaaagttggtgggaacagatactttaccttcttaaacaggagtttaggagcagtgggtccccatcttttggactagctcttaacgttacttttccccgctgtagtgtagcacagccactccccttcactgggggacctcagtgagttggtcagctctcttggccttacatgtggcagttgttttcttgtttgcaggtgcggccgggtgtgtggcaacattacttcatgatgcagccatgaaccctgcggaagtggtcaagcagaggatgcagatgtacaactcaccataccaccgggtgacagactgtgtacgggcagtgtggcaaaatgaaggggccggggccttttaccgcagctacaccacccagctgaccatgaacgttcctttccaagccattcacttcatgacctatgaattcctgcaggagcactttaacccccagagacggtacaacccaagctcccacgtcctctctggagcttgcgcaggagctgtagctgccgcagccacaaccccactggacgtttgcaaaacactgctcaacacccaggagtccttggctttgaactcacacattacaggacatatcacaggcatggctagtgccttcaggacggtatatcaagtaggtggggtgaccgcctatttccgaggggtgcaggccagagtaatttaccagatcccctccacagccatcgcatggtctgtgtatgagttcttcaaatacctaatcactaaaaggcaagaagagtggagggctggcaagtgaagtagcactgaacgaagccaggggttcagatgacactgctgcatcctggtcacattctctgtctcctggaatgctcccacctcaagtggagttagaaggaaggtagaggggctctcccccaggattttggtgttttgactaacaccagttcctgccaacctctgttgccaccacctttccttccaggccctaagcacgtgcagcaaagcacaccacagcacctttgataacctctctccatcctgggcctgatgacctgctctagactgttatagagggataagcagctcattcccctggttcctaataaaaagcctttaaatt

SEQ ID NO: 103 - DNA, 2354 bp, Homo sapiens
gttccctgtcatcagtatgcagcgattgctctttccgccgttgagggccttgaaggggaggcagtatctgccgctcctggctcctagggcagcgcctagagcacagtgtgattgcatcaggcgccctttgaggccagggcaatacagcaccatctctgaagtagctttgcaatctggaaggggtacagtgtcccttccctcaaaggctgctgagcgggtggtgggccgatggctcctggtctgcagtggaacagtggctggagcagttattcttggtggagtaactaggttgacagagtctggcctctcgatggtagattggcatttaataaaggagatgaagccacctacaagccaagaggaatgggaagcagaattccaaagataccagcaatttccagaatttaaaatcttgaatcatgatatgacactgacagaattcaagttcatctggtacatggagtactcacaccgaatgtggggtcgccttgtaggccttgtgtacatcctgcctgctgcctacttttggagaaagggctggctcagccgtggcatgaaaggacgtgttcttgccctctgtggcctcgtctgcttccagggtctgttgggatggtatatggtgaaaagtggactagaagaaaaatcagactcccatgacatccctcgggtcagtcagtaccgccttgctgcccacctgggatcagccctggttctttattgtgccagcttgtggacctcactgtcactgctactccctccgcacaagttgcctgaaacccaccaactcctacagttgagacgatttgctcatggaacagcaggtctggtgttccttacggccctctcaggggcttttgtggcagggctagatgctgggcttgtttataactcctttcccaaaatgggagaatcctggatcccggaggacctctttaccttctcccccatcctgaggaatgtttttgagaatcccaccatggtgcagtttgatcaccggattctgggaatcacttcagtcactgccattacagtgctctacttcctctctcggagaattccccttcctagaaggaccaagatggcagcagtgactctgctggctttggcgtatacacaggtgggcttgggcatcagcacgctgctgatgtatgtcccaactcctctggccgccactcaccagtcaggctccttggctttgctcactggtgctctttggctgatgaatgaactccgaagagtcccaaaatgattcttagaggaccagcctcctgggactgtgactgcttttgagagctcttcagagatcataagaacttgggcttttctacgagatgaccttgacataccaagtggtttccaaatggtcaacttacttaaaaatcttttcctgttttgagatagtcactggatcaagaatgcattaagtgtggttaccctaaatgttcccttttaaatctgcttttcatgttgaaaatcagttttaatgtagagaaagaaatgtctgccatttgctgcttaacaggctttgtgtcaggtttttcagtgttggcaagctcttggttctacgtggatgatttctacgtggatgttctcctgagtccttaattctgcctaaatagaatttctttatgatcttaacttcacttccattaggtgaagattgaaaggataggattgacatacccaaagtagccagctggtcttcagcaaaaaaaaaaaagctaatgtcttctaatatcctgattttcagaaatggggaaattgcagattttgacaagcttaatgtgtatatgtagcaaaatggtttttaagtacttggaaaaggaggtaatcgccaaatagttccatttttttttttttttttgagacagagtttcactcttgttgcccaggctggagtacaatggcgtgatctcagctcactctgcaacctccacttcccaggttcaagcgattctcatgcctcagcctcccgagtagctgggactacaggcacaagtcaccatgcctggctaattttgtatttttagtagagaaggggtttcaccacattggccaggctggtcttgaactcctgacctcaggtaatccgcccatctcggcttcccaaagtgctgagattacaggcatgggccaccacgcccagctagttcctcttttgataaggctgttaacattacaaggtcagagagaggaatggaatcgacagtataaattggttcctgagagggtttcctaacagctttgtaataagaaaaatatggccttgatggtgtagtgcatggacatctacccagataaacaaattgttgactgctgaaaaaaaaaaaaaaaaaaaaaaaaaaaaaaaaaaa

SEQ ID NO: 104 - DNA, 1370 bp, Homo sapiens
ggggcacccactggaaggagaggccaggcggaagaccctggctccgtcatggcctctgccctgaggccaccccgtgtccccaagcctaagggtgtcctgccttcacactactatgagagctttctagagaagaaggggccctgtgaccgggattacaagaagttctgggcaggcctgcagggtctcaccatttatttctacaatagcaatcgggacttccagcacgtggagaagctcaacttgggagcatttgagaaactcacagatgagattccctggggaagctcacgtgaccctggcacccacttcagcctgattctccggaatcaggagatcaagttcaaggtagagaccttggagtgtcgggaaatgtggaaaggcttcatcttaacggtggtggagctccgtgtcccgaccgacttgaccctgcttcctgggcacctatacatgatgtctgaagtcttggccaaagaggaggcgcgccgtgcactggagacaccctcgtgcttcctgaaggtgagccggctggaggcacaactgctcctggagcgctaccccgagtgcgggaacctgctgctgcggcccagcggggacggcgccgacggcgtgtcggtcaccacgcggcagatgcacaacgggacgcacgtggtccggcattacaaggtgaagcgggagggccccaagtacgtgatcgatgtggaacagccgttctcttgcacctccctggacgccgtggtcaactatttcgtgtcgcataccaaaaaggcgctggtgccattcctgttagacgaggactacgagaaggtgctaggctacgtggaagccgataaggagaatggcgagaatgtgtgggtggcgccctccgctccgggcccaggtcctgcaccctgcacaggtggccccaagccgctgtcacctgcgtctagccaggacaagctgcccccactgcccccactaccgaaccaggaagagaactacgtgacccccattggagatggcccagctgttgactatgagaaccaagatgtggcttcctctagttggccagtcatcctgaagccaaagaagttgccaaagcctcctgccaagcttccaaagccacccgttggacccaagccagagcccaaagtctttaatggtggcttgggcaggaagctgccagtcagttcagcccagcctctcttccccacagccgggctggcagacatgacggcagagctacagaagaagctggagaagaggcgggcactggagcactgattcggacacaccagggaccagcgggctagtcccagggcatggcccagcggccagattctttttcccaggattaaaactctgaccccaggaaaaaaaaaaaaaaaaaaaaa

SEQ ID NO: 105 - DNA, 2160 bp, Homo sapiens
ccagaacacccctatcttctaggattgacactggctgtcaaactcatccttcaaggtgattcctggcctgccctcctcctccaggcagcctgtcctcctcctccaggcagcctgtcctgaccctcagcagcctctcctggccttggcagagcccctcgtgtcctcccttgcagcacgcatgggaagaaaggccatcgtcctcgccattgctaacaccagccttgcgtttcctctttgccagcacctggtgacgttctgcctgggtgaggacgatggcgtgcataccgtggaggatgcctccaggaagttggccgtcatggatagccagggccgagtctgggcacaggagatgctgctgcgagtgtctcccgaccatgtcacgctgctcgacccggcctccaaggaggagctggagtcgtacccactgggcgccatcgtgcgctgtgacgcggtgatgccacccggcaggagccgctcgttgctgctgctcgtgtgccaggaacccgagcgcgcgcagcccgacgtgcacttcttccagggcctgcgcctcggggcggagctgatccgagaggacatccagggggctctgcacaattaccgctcgggccgcggggagcgcagggcggcggcgctcagggccacgcaggaggagttgcagcgcgaccgctcgcccgccgctgagaccccgcccctgcagcgccgcccgtcagtccgcgcagtgatcagcaccgtagagcggggcgcgggccgcggacgaccccaggcgaagcccattcccgaggcagaggaggcgcagaggcctgagccggtggggacctcgagcaacgctgactcggcctccccggacctgggtccccggggtcctgacctggcggttctgcaggcggagcgggaagtggacatcctgaaccacgtgttcgacgacgtagagagctttgtatcgaggctgcagaagtcggcggaggcggccagggtgctggagcaccgggaacgcggccgcaggagccggcgccgggcggctggggagggcttgctgacgctgcgggccaagccgccctcggaggccgagtacaccgacgtgctgcagaagatcaagtacgccttcagcctgctggcccggctgcgcggcaacatcgccgacccctcctctccggagctgttgcacttccttttcgggcctctgcagatgattgtgaacacgtcgggggggccggagttcgcgagcagtgtgcggcggccgcatctgacatcggatgccgtggcgctgctgcgggacaacgtcactccacgtgaaaacgagctctggacctcgctgggggactcgtggacccgccccgggctggagctgtccccggaggagggacccccatacagacccgagttcttcagcggctgggagccgccggtcactgacccgcagagccgcgcctgggaggacccagttgagaaacagctacagcacgagcggaggcgccggcaggtgacccaagcgacacagcagggccgaggctgggaagtccgggggcgcggccggtccgcctggccccgcctgacccgactgtcttacttcctacagcaaagcgccccccaggtcgctgtcaatggtcaccgagacttggagccagaatctgagcctcagctggagtcagagacagcaggaaaatgggtcctgtgtaattatgacttccaggcccgcaacagcagtgagctgtcggtcaagcagcgggacgtactggaggtcctggaggacaaagagaaagtgtcagagctggaggcagtgatggagaagcaaaagaagaaggtggaaggcgaggtggaaatggaggtcatttgacctgccaggcgcccttcgcaaagagtgacgaggccccgtgggagaacggactcctcagactctccccaatagcggaagtcgatcttctgaaggatggccaatctgctccggccctggtcttcccccatcccggtggacagacttaacgatccttgctgcagtccctccggagaggatctggactggctgggagtggggagggcgtggagacagtctacggaaagcgctagcagacccccgagagggtgcagtggagccctgagcattgtaatatgcggcccagcctataaacagcctccgtgcttaaaaaaaaaaaaaaaaaaaaa

SEQ ID NO: 106 - DNA, 571 bp, Homo sapiens
gcatatacatacaggtttatttaaatgattggatctacacttttggaggctatttgaagtatcttatcaaaataaaacgcattttaagcaagaagttaaaaaagcttttcagacccgaaggccatttaatacagtaaatcttacttgggtagtttagcaaacattttttaaaacccacatccaacagattggttagtattagatacacagatttggtttcaaagctgaaatacccctggtggaataaatcttctcatgaaattcagttatattatgccacaaaacagggacacttatctattgacaacttaaatattaactcagtgggctacctggtgatataaataggaaaaaaacagtggtcatggattaggagtgagaagactatgacaccagcctaccttggactgggaccgcaaaggatgttaaaatctatcctagaatttaaaacaggagaaatgtcaaatattccagtctccattcggctcaagccatcgcccaaggaatacacccccaccccagccccacatgaggtttactaaccagctgctacagatgttactatgtcact

SEQ ID NO: 107 - DNA, 644 bp, Homo sapiens
  misc_feature (1)..(644): n = a,c,t, or g
gcatcctcctgccttggcctcccgagtagctgggactacaggcgcacaccaccatgccaagctaatttttaaatttttttgtagagatggggtctcacttttgttgcccagggtgctttagaacccctgggctcaagtgatccttgacctcccacagtgctgggattacaggtgtgagccaccgtgcctggcctcatgggttttctttgttttgttttgttttgtttttgagacagagtctcactctgtcactcaggctggagtgcagtggcacgattttggctcactgcaacctccaccttccgggttcaagcgattctcctgcctccgcctcccgagtagttggggttacaggcatgcgctaccacacctggctagttttttattgttgttgttttttgtatttttagtggtgacggggtttgctctgttggccaggctggtctcaaactcctgacctcaggtgatccccacttcagcctcccaaagtgctgggatgacaggcatgagcctctgcacctggcctcgtgtnttttttttagttagccattttatacgtgtttactgaacacctgtcctgtgcccatattctaagtgccttacctgcattaaactcatgtaaccttcacaacccgaaaaaaaaa

SEQ ID NO: 108 - DNA, 448 bp, Homo sapiens
tttttttgggaacatttactaatcttttatttgcttttcttggcactcataacattttttaccctttaaaacagattcaagtgattcaaattccagttacctctaagttatattctgttaacaaccaccttgtataaattggtttcataaataaaaactgctcttaaatgattctgtcagtggatgtctatccacaagctttccagcctggtctgctttatgtgtacatcctgaaaatttgccaaaatagcagcaacaactgatgatatcatagggaaaaaactcactgccacaagaaaccaagcattgttgagtcaacttctttttggtcacttgttttatacttactagataagccaaaagacctgtttgttacacaaacatgcatgcatccaggtattaatccattctcacactgctatgaagaaatacccgagactgggtaatt

SEQ ID NO: 109 - DNA, 3319 bp, Homo sapiens
ggcccggcccgcggcggcggcaaaggggcggaggggttcgctgccagcaattgccaagctgctgcggtcgtggcgggatggtatagccgggcctgagggcgggcggcggggcgcgggcgggggcgaggcggccgggaagggccgacgccgcctgactggcttgggagcagcggcagcaagctgagggggcgtcgccgccgccggcccccggcgccgccgcgggaggccgcgcccgccatggcggcccgggcggtgctggacgagttcactgcgccagctgagaaggcggagctgctggagcagagccgcggccgtatcgagggcctgtttggcgtgagcctagccgtgctcggcgcgctaggggctgaggagccgctgcccgcgcgcatctggctgcagctctgcggggcgcaggaggcggagcacagcgccaaggaatatattaaaggaatctgtgaacctgaactagaagaaagagaatgttaccccaaggacatgcactgcatttttgttggggcagagagcctgtttctgaaaagcttgattcaggatacttgtgctgacctctgcattctggacattggccttcttggcatcagaggaagtgctgaggctgtggtcatggctaggagtcacattcaacaatttgtaaagctctttgaaaataaagagaacctacccagtagtcagaaagaatcagaggtgaaaagggaattcaaacaatttgttgaagcccatgcagacaattacacaatggatttgttgattttgcccacttccttgaaaaaagaacttttgacactcacacaaggtgaggagaatctctttgaaacaggagatgatgaggttattgaaatgagagattctcaacaaacagagtttacacagaatgctgccacagggctgaatatttctagagatgaaactgttttgcaggaagaggcaagaaataaagctgggactcctgtttctgagcttacaaaacaaatggacacagtcctttctagctcaccagatgtgctttttgatccaataaatggtctaaccccagatgaagaggcactttccaatgagagaatttgtcagaaaaggagattttctgattctgaagaaaggcatacgaagaagcagttttctttggaaaatgttcaggagggggagattttacacgatgctaagacattggctggaaatgtaatagctgacctatctgattcttctgctgattctgaaaatttaagtccagatataaaagaaactactgaggaaatggaatacaacatcctcgtaaacttttttaaaaccatgggctactcccaagaaattgttgaaaaggtcattaaggtgtatggaccatctactgaaccattattgctcttagaggaaattgaaaaagaaaataaaagattccaagaagacagagaattttcagctggtacagtgtatccagagaccaacaaaaccaaaaataaaggtgtttatagcagcacaaatgagcttacaactgattccactccaaagaaaacacaggctcacacacagcaaaatatggtagaaaaattttctcagttaccattcaaagtggaagctaaaccatgtacctcaaattgtagaattaatactttcagaacagtgccaatagaacagaaacatgaagtctggggttcaaaccagaactacatttgtaacacagaccctgaaactgatggcctttcaccttctgttgcctctccaagtcccaaagaagtcaattttgtttcaaggggagcttcaagtcaccagcccagagttccactttttcctgaaaatggtttacaccagcagccagaacccttgcttccaaataatatgaaatctgcctgtgaaaaacgtttaggatgttgtagttctcctcattctaagccaaattgctcaaccctttctccaccaatgccactgccccagctgttaccttcggttactgatgcaaggtcggcaggaccttctgatcatattgattcctcagttactggggttcaaaggtttcgagatactctaaaaataccctacaagctggaattaaaaaatgaaccagggagaacggatttgaaacacattgttatagatgggagcaatgttgcaattacccatggtctgaaaaagttcttttcttgtcgtggaattgcaattgcagttgaatatttttggaagcttggcaacagaaacatcactgtatttgtccctcagtggagaacaaggcgtgatcctaatgtcacagaacagcacttcttaacccagctccaggagctcggaatattatctttaactcctgcccggatggtctttggagaaagaattgcttctcatgatgacaggtttctactacacttagcggacaaaactggtggcataattgtgacaaatgataatttcagagaatttgtgaatgagtcagtctcttggagagaaattattacaaaaaggctgctgcagtacacgttcgtgggggacatatttatggttcccgatgatcctctgggaagaagtggacctcgattagaggagtttcttcagaaggaagtctgtcttagagatatgcagcccctactcagtgccctgccaaatgtgggcatgtttgaccccagcttcagagtccctggcacccaggcagccagcaccagccaccagcctccgacccggattcagggagccccttcaagccactggctccctcagcagccccacttcccactgctgccagccctccccagtctccagcagaacctgcccatgccagctcagagatcttctgcagaaaccaacgagctgagggaagcccttctgaagatcttccctgactcagagcaaagactgaaaatagaccagatcttggtggcccacccatacatgaaagatctaaatgcgctttctgccatggtgttggattgaagattgtgctgagcgctgagcttgcgctcagggctggctgatcaaactcaagctcacacctgtacctgatgggaatgaacataatgtgaagaaacttatttcccagtgtaaacgcagttgtacagaaaaaaaatgttttgggtataaatctgggttttcaaaaccagcttttttctatatataaattatgctgctattacagatttaacattttctgttaaaggaaagtctacattttctgcctgttcagaactgtttaatagcagttactcttgagtgtatttacctttttatgttttttaaactattttccttaaagccgaaaatattgacaaatggatatggttagcctttataaataaataaaaaaaaaagtgttgctttcttaagg

SEQ ID NO: 110 - DNA, 531 bp, Homo sapiens
  misc_feature (1)..(531): n = a,c,t, or g
ttttttttcaaactgcaaaacccgttttatttttaataaaaggcctcacttccaaggagagcccagcccaggagatccccggtgaatcgtcaagcctgggtcctcggggagccggcgttcctgctgagctgatgttgtacttctgaaggcctgtgatcgctaactgcaccatgaggcagaatncangggtgctctcaaccagctgggggttggggttcaggctttttttcatctttcggccaaggcagacaacaacggactcatcatcccacgcgactgagtgacgcgaggcttcaaacgcaagcacgagtgtttagaatcctgcattttcaaaggctcttgcccactgggaactacatggagaggagattaagaacaacaaccaaaagaggcagggggtggggcaggcttgaggtaggggtgggntgggntgacagtcaacacagctnggaccagaagnccatggnccctggctccctggaaaggcacagggcacagacggatgccgccttttcttgctgggacactcct

SEQ ID NO: 111 - DNA, 10802 bp, Homo sapiens
gtgtcggacggcatgacaggcagcaatcctgtgtcccctgcctcatccagttccccagcctctagtggggcaggcggcatctccccgcagcacatagctcaagattcctcactggatggacctccaggccccccagatggtgccacagtgcccctggaggggttcagcttatcccaggctgctgacctggctaacaagggcccgaagtgggagaagagccatgccgaaattgcagaacaggccaagcatgaggccgagatcgagactcggattgctgagctgcggaaggagggtttctggtcactgaagaggctgcctaaggtgccagagccccctcgccccaaaggtcactgggactatttgtgcgaagagatgcagtggctctctgctgactttgctcaggagcgccgttggaaacggggtgtggcccggaaggtggtgcgcatggtgatccggcaccacgaggagcagcggcagaaagaggaacgggcccggagggaggagcaggccaagctgcgtcgaattgcttccaccatggccaaggatgtcaggcagttctggagcaatgtggagaaggtggtgcaattcaagcaacagtcccggcttgaggaaaagcgcaaaaaagccctggacctgcatttggacttcattgtggggcaaactgaaaagtactcggaccttctgtctcagagcctcaaccagccattaacctccagcaaagcaggctcttccccttgcctcggctcttcctcagctgcctccagtcctccaccccctgcttctcgcctggatgatgaagatggggactttcaaccccaagaggatgaggaagaggatgatgaggaaacgattgaagttgaagaacaacaggaaggcaatgatgcagaggcccagaggcgtgagattgagctgcttcgccgtgagggagaattgccactggaagagctgctccgttcccttccccctcagctgttggaagggccttccagcccctctcaaaccccctcatctcatgatagtgacacccgagatgggcctgaagaaggtgctgaagaagagccccctcaggtgttggagataaagcccccaccctctgctgtcacacagcgcaacaaacagccttggcatccagatgaagatgatgaagagtttactgccaacgaagaggaagcggaggatgaagaggatactatagcagctgaggaacagttggaaggggaggtggatcatgccatggagctgagcgagttggctcgagaaggtgagctttccatggaggagctattgcagcagtatgcaggagcctatgccccaggctctgggagcagtgaagatgaggatgaagatgaggttgatgctaatagctctgactgtgaaccagaggggcccgtggaagcggaagagcctcctcaggaggatagtagcagtcagtcagactctgtggaggaccggagtgaggatgaggaagatgaacattcagaggaggaagaaacaagtggaagttcagcatcagaggaatctgagtctgaagagtctgaggatgcccaatcacagagccaagcagatgaagaggaggaagatgatgattttggggtggagtacttgcttgccagggatgaagagcagagtgaggcagatgcaggcagtgggcctcctactccagggcccactactctaggtccaaagaaagaaattactgacattgctgcagcagctgaaagtctccagcccaagggttacacgctggccacgacccaggtaaagacgcccattcccctgcttctgcggggccagctccgggagtaccagcacattgggctagactggctggttaccatgtatgagaagaagcttaatggcattcttgctgatgagatggggcttgggaagaccatccagaccatctctctgcttgcccacttggcttgtgagaaaggtaactggggtccccatttaatcattgttcccaccagcgtgatgttgaactgggagatggagttgaaacgttggtgccccagctttaaaatcctcacttactatggagcccagaaagagaggaagctcaagcggcagggctggaccaagcccaatgcctttcatgtgtgtatcacatcttacaagctggtgctgcaggaccaccaggccttccgtcgcaagaactggcgctatctcattctggatgaggcgcagaacatcaagaacttcaagtcacagcgctggcagtcactcctcaacttcaacagccagagacgcctgctcctgacaggaactcccttgcagaacagcctcatggagctgtggtccttgatgcactttttgatgccccatgtcttccagtctcatcgcgagttcaaggagtggttctctaatcccctaactggcatgattgagggcagccaagagtataatgaaggtctagtcaaacgcctccacaaggttttgaggccttttttactgcgccgagttaaggtggatgttgagaagcagatgcccaaaaagtacgagcatgttatccgctgcaggctctccaagcgtcaacgctgtctctatgatgacttcatggcacagaccacaactaaggagacactagccacaggccatttcatgagcgtcatcaacattttgatgcagctgagaaaagtttgcaatcatccaaatctgttcgaccctcgaccggttacctcccctttcatcaccccaggcatctgcttcagcaccgcctctctggtgctaagggccacggatgtccatcccctccagcggatagacatgggtcgatttgaccttattggcctggaaggtcgtgtctctcgatatgaggcagacacatttctgccccggcaccgcctctctcgccgggtactgttagaagtggctactgctcctgaccccccaccccggcccaagccagtcaagatgaaggtcaacaggatgctgcagccagtacctaagcaagaaggccggacagtggtggtggtgaacaacccacgggcgcccctgggccctgtcccagttcgacctcctccaggtcctgagctctcagcccagcccacccctggcccagtcccccaagtgctgccagcatcactgatggtttcagcctcacctgccgggcccccgcttattcctgcatctcggcctcctggccctgtcctcttgcctccactgcagcccaacagtggttctctcccccaggcaggcgaagtggtcagcatcgggcagttagcctcactggcacaacgtccagtggctaatgcagggggaagcaaacctctcaccttccaaatccagggcaacaagctgactttgactggtgcccaggtgcgccagcttgctgtggggcagccccgcccgctgcaaatgccaccaaccatggtgaataatacaggcgtggtgaagattgtagtgagacaagcccctcgggatggactgactcctgttcctccattggccccagcaccccggcctccgagctctgggcttccagctgtgttgaatccacgccccacgttaacccctggccggctacccacacctactctgggtactgctcgagcccccatgcccacacccactctggtgaggcctcttctcaagctggtccacagtccttcacctgaagtcagtgcttcagcccccggagctgcccccttgaccatctcttctcctctccacgtgccatcctcactccctgggccagcctcttctccaatgccaattcccaactcctctccccttgctagtcctgtgtcctctacagtctcagttccattgtcatcttcactccccatctctgtccccaccacacttcctgccccagcctcggctccactcaccatccccatctcagcccccttgactgtttctgcttcgggcccagctctgttgaccagtgtgactccaccattggcacctgttgtcccagcggctcctggacctccctccttggcaccatctggtgcttccccgtcagcatcagccttgactctaggtttggccacagctccatccctgtcttcatctcagacacctggtcaccctctgttgttggctcccacctcttcacatgttccagggttgaactcaaccgtggccccagcatgctcacctgtcctggtgccagcttcggctctggccagtccttttccgtcagcaccaaatccagctccagctcaggcttcccttctggctccagcatcttctgcatctcaggctctagccacccctctggctcctatggcggctccacagacagcaattctggctccttctccagctcctcctctggctcctcttccggtcctggcaccatcgccaggtgctgctcctgtcctggcttcatcacagactccggttccagttatggctccatcgtctactccaggaacctctttagcctcagcttcaccggtaccagctccaacccctgtgttggctccatcatcaactcaaactatgctaccagccccggttccgtcacctctcccgagcccggcttctacgcagacactggccctagccccagctttagcacccactcttggaggctcatctccatctcagacactctctttgggaacggggaacccccagggaccctttccaactcagacattgtcattaactccagcatcatccctggtaccaactccagcccagacactgtctttggcaccaggaccaccactgggtccaactcagacgctgtctctggctccagcaccccctctggctccagcttctccagtgggcccagccccagctcacacgctgactttggctccagcatcgtcatctgcttcactcctggccccagcttcagtgcagacactgaccttgagccctgccccagttcctaccctgggcccggccgcagctcagaccttggcgctggccccagcctccacacagtccccagcttcccaggcatcttcccttgtggtttcggcatctggtgccgctcccttgcctgtcaccatggtatcccggctgcctgtttccaaggatgagcctgacacactgacattgcgctctggtccccccagccctccctccactgctacctcgtttggtggcccccggcctcgacgccagccccccccaccacctcgttcccctttttatctggactccctggaggaaaagcggaagcggcagcggtctgaacgcctggaacggattttccaacttagtgaggctcatggggccctggcacctgtgtatgggactgaagtcctggatttctgtaccctgccccaacctgttgccagccccatcggccctcgttctcctggccccagccaccccaccttttggacttataccgaggctgcccaccgggctgtactgtttccccagcagcgactagaccagctgtcagaaatcattgagaggttcatctttgtcatgcctcctgtggaggcacctcccccttccctgcatgcctgccacccacctccttggctggccccacgtcaggcagccttccaggagcaattggcctctgagctctggccccgggctcgtcctttgcaccgtattgtgtgtaacatgcgcacccagttccctgacttaagactcatccagtatgattgcggaaagttgcagacgttggcagtgctgttgcggcagctcaaggcagagggccaccgagtgctcatcttcacccagatgacccgaatgctggatgtattggagcagtttctcacctaccatggccatctctacctgcgcctggatggatctactagagttgaacagagacaggccttgatggaacggttcaatgcagacaaacgcatattctgcttcatcctttcaactcggagtgggggtgtgggcgtgaacctgacaggagcagacactgttgttttttatgacagcgactggaatcccaccatggatgctcaggcccaggaccgctgtcaccgaattggccagacccgggatgtccacatatataggcttatcagtgaacggacagtggaggagaacatcctaaaaaaggcaaatcagaagagaatgttgggggacatggccattgagggaggcaacttcaccacagcctatttcaaacagcagaccatccgagagctgtttgatatgcccctggaggaaccttctagctcatccgtgccctctgcccctgaagaggaggaagagactgtggccagcaagcagactcatattctggagcaggcattgtgtcgggcagaagatgaagaggatatccgtgcagccacccaggccaaggctgaacaggtggctgagcttgcagaatttaatgagaacgatgggtttcctgctggtgagggagaggaagctggccggcctggggctgaggatgaggagatgtcccgggctgagcaggaaattgctgccctcgtagaacagctgacccccattgagcgctatgccatgaaattcctggaggcctcactggaggaggtgagccgagaggagctcaaacaggcagaagagcaagtggaagctgcccgcaaagacctggaccaagccaaggaggaggtgttccgcctaccccaagaggaggaggaggggccgggggctggggatgagagttcctgtgggactggtggaggcacccaccggcgcagtaaaaaggccaaagcccctgagaggccggggactcgtgtcagtgagcgtcttcgtggagcccgggctgagactcaaggggcaaaccacactcctgtcatatccgcccatcaaactcgcagcaccaccacaccaccccgctgcagtcctgccagggagcgagttcccaggccagcacctaggcctcgacccactccagcttcagctccggctgcaattcctgcccttgttcctgtcccagtttctgccccagtacccatttcagccccaaatccaataaccattctccctgtccatatcttgccttctcctccccctccttcacagattcctccttgttcttctcctgcctgcacccctcctcctgcctgtacccctccaccagctcatacaccgcctccagcccaaacctgtcttgtaactccttcctctcctctcttgcttggtccaccttctgtgcccatctctgcctcagtcactaatctccccttgggcttgaggcctgaggcagagctgtgtgcccaggcattggcatctccagagtccctggagctggcttctgtggccagttcagaaacctcctcactttctcttgtgccccctaaagatctgttgccagttgctgtggagatcctgcctgtgtcagagaagaacctttctctcaccccttctgcacccagcctgaccttggaggctggcagcatccccaatggtcaagagcaggaggcaccagattctgctgaggggaccacccttacagtgctgcctgaaggtgaggagttgcccctgtgtgtgagtgagagcaatggcctggagctcccaccctcagcagcatctgatgagccacttcaggagccactggaggctgacaggacctcggaagagctgacagaggccaagaccccaacctccagcccagagaagccacaggaactcgttacagctgaggttgcagctccatccacctcatcttcagccacttcctcgcctgagggtccttcacctgcccgacctcctcggcgtcgcaccagtgctgatgtggaaattaggggtcaagggactggtcggccaggacaaccaccaggccccaaagtgcttcgaaagctgccaggacggctggtaactgtggtagaggaaaaggaactggtgcggcggcggcggcagcagcggggagctgccagcaccctagtgcctggggtctctgagactagtgccagcccgggaagcccgtctgtccgcagcatgtcagggccagaatcctcccctcccattggtgggccctgtgaagctgctccttcatcctcactgcccactccaccccagcagcccttcattgctcgccgtcacattgagctgggggtgactggtggtggcagccccgagaatggagacggagcactgctcgccatcaccccacctgctgtgaaacgtcggagggggaggccccccaagaagaacaggtctccagcagatgctgggagaggtgtggatgaggcaccctcatccaccttgaagggaaaaaccaatggggctgacccagtccctgggcctgagaccctaattgttgcagatcctgtcctggaaccacagcttattcctgggccccagcctcttggaccccagccagttcacagacccaatcccctcctgtcacctgtggagaaaagaaggcgaggacgaccccctaaagcacgagatttgcccatccctgggaccatttcctctgcaggggatggcaactccgaaagtcggacacagccacccccacacccatcacccctaaccccactcccaccactgctagtttgtcccactgctactgttgccaacactgtcaccactgtcaccatttcaacgtccccacccaaacggaagaggggccgacctcccaagaatcctccatcacctcggcccagccagctccccgtcttggaccgtgacagcacttctgttctcgagagctgtggattggggaggcgacggcaaccccagggccaaggggagagtgagggtagttcctctgatgaggatggaagccgccccctcacccgcctggcccgccttcggcttgaagcagaaggaatgcgaggacggaagagtggagggtccatggtggtggctgtaattcaggatgacctggacttagcagatagcgggccaggcgggttggaattgacaccacctgtggtctcactaaccccaaaactgcgctcgacccggctgcgtccagggtctctagtccccccactagagactgagaagttgcctcgcaaacgagcaggggccccagttggtgggagtcctgggctggcaaagcggggccgcctacagcccccaagtcccctggggcctgagggttcagtagaggagtctgaggctgaagcctcaggtgaggaggaggaaggggatgggaccccacgccgacgtcctggcccccgccggcttgttgggaccaccaaccaaggggaccagcgcatcctgcgcagcagcgcccctccctccctggctggccctgctgttagtcacagaggccgcaaggccaagacgtgagtgggctgcccctccacctaggctttccaccgtggccactccctccatgaccaggcctgactctgttaaccactacttgaagtcttgagggggaaagcctccagggagacataggggccttctcccttcttcccaccaaagtagggggtaggcaactggttgtcatggaaatggggatcatcacagtccccttccccttcaccccacgtggctgggcagtgttaagggtggcaagatagtctctgtccccacccccttgtacttgattccccagctgtctttcacacagccccccacccttaggggaagggggaggggcttctctacaatgaggtttttttcttttttttttttttttaagaagaaaaaataataaacttagtttctgtatgagcatccgcgtaaggaggcttctgattttctggtctggtggagggttgggtgggaacttgggcatcgtttttctcctccctcttgttcttgcaaagatcctagcacctgatctctagcccaggactatatgttccaggcagaaatctacccaagaagagggaagattggtgaatttgatgtggtagggtgcctttccccagtcagtttgaagtcacagatatccttttcctctcatttcttttccctcggttcctagacgttcctcggagctctttgatgcctcagacctttcccttttatccctcttgctcaggtgcttcctttcacaactttttccagagggcaggcgtcctagctccagttgctccatcccttgggccctcccctggctcttcatctagccaaactggtttgagtcagccacaccccttcccagctccctgggctcttcacgtggtggctggccactcaaccccacccctgggcttggcttggagccctgagtcagctccatcaccacccaagccaaaccaaagctgaggcaggagccgaaactcagagtccttcaaggcctatagccaggtgatggaggacgaggagaaggcagtggagatcttgggcaacacggaagctgctcatcctccatcccccatccgctgctgctggctccgcctccgctgcttggcagctactagcattatctgtggctgctcttgcctgggagtcatggctctggtgtttgccatcaaggcggaagagcggcataaagcaggccggtccgaggaggcagtgcgctggggggcccgggcccggaaactcatcctggccagctttgctgtctggcttgctgtcctcattctgggtcccctgctgctgtggttgctctcctacgccatcgctcaggctgagtgaccctggatggcctctgctgagagccagccgagacctcctggatcctgcaatgcggcattgctaaggtcctgtgacagcagtggttggaaggatcctggttggaaggatggggactctctcaaggggctttggaagagctcttctagccctttataaaaggagggcagcagctgagactgatgagaggagggcagcctgctctgttctttcagggccccccacccccatctcccctaccctagcccaccctagggcctctacccagcgggaggggttgaagaccaggcctggttttattagaattcattttgtaataaaagccttttttagtggtg

SEQ ID NO: 112 - DNA, 544 bp, Homo sapiens
  misc_feature (1)..(544): n = a,c,t, or g
ccggtatccattggtagtttatttctttagggttctatcccaaccagtcgcttaaaaaccaagtaacacagacctgaggggtgggggctggggactgcacctccctcctactcatggtggacagcagtggggactagggaggggcaggagaggtggctgaagcaaggcagcagtaatggggccacgacgccacagagccagctccgtcctctcccagaccctggtgggagtccctgtggcttggggtggggagtgggggacccaacccaggcccctccctttcccttcctcagacagccttctttcgggctcaacccatttcttccggcaggagactgaggcacacagagaggaggaagtgggagaggaggacgagggaggggcagggtggcagcacaaatgaaggcagaggtgagaggcgtgggcaaggccactccacccccacacccaccccagagaggggcgaggaagccacaccatcacgcagcatgtcggngggacaaggcggggtttaaggctgaggggcccggggcaggcggngcct

SEQ ID NO: 113 - DNA, 508 bp, Homo sapiens
  misc_feature (1)..(508): n = a,c,t, or g
ctcggctttactgcagcctccgcttcctgggttcaagcgattctcctgcctcagcctcccgagtagctgggactacaggcgcgtgtgccacgccggctaatttttngtatttttagtagagatggagtttcaccatgttacccaggatggtctcaatatcctgagttcatgatccacccaccttggcctcccaaagtgctgggattacaggcgtgacacncacacccagccagttttcctattttctgaattcagaattgacttctctgggaaaactggagatgagaatctgcccagtgctctgctgtccagtcaccgccttttgaattttagttttgggcaccagggagtaccgttagctttccccttctttctggcccatttgactcatcagcacaataggggtcaacacctttaactttttaatttctaantttgttttattgtctttaggggtgtgtatggaaataaaacattgaacagggtttcttggaggccctcaaggtgt

SEQ ID NO: 114 - DNA, 982 bp, Homo sapiens
ttagattcatctttttaatgacatcctaaaattcagaggaggggccagcgggacctctgggctcagcggctgtgaaggagggacccgcaacacccgctaaggcaggtaattgcaagaaggcactcgcgagggggacttcaagcccctcttctatttcttcatataaaatcagggggatggggaaagctccaagggcgagggaagcagagagagtttctctcccagcctatggaataaggaagaggtgaggaaggggcgggtgctgggagcaagaaactgccaagtccaggacctgccctcacacagacacacacagcccgcacctgccctccctctaaaatctgcatccggggctgtaaggaagccccgtgttcaagcccccatctcttctcccttctagctggtacgaattggtaatcgccactctgggtgatgtagcgaacccagggcagggcctggtaaccacttttctcaatgatcttcatgtatcggacctggatcccagagacggtgaagtaggggatctcaaacttgaccccgatggggggccggcctccacctcttccttttccacactggggaggccaaagtgggctcgcatcaagtactccttgccccccggaaagacttaaatactcaaatcacgacgtttctctgcggcacatacttggcgctgcccacactggtcttgaatctgggggagtcggcatcgctgggtacaggcacagattatctcacaccgttggccactgactgtttactaaactgccccttgccttgaccatgaatcccacgcggctgtgggagaactttcaatgacagaatcaatccaattagttggcttagctgggtgctggggcggtatgacatgagcccaaattcacctcaggcgggaagaaaggatagggtgcgtcgttatcaagcagaagaacccgacggcctggtggaatttttaatcttcaactcttaatgatttgttttt

SEQ ID NO: 115 - DNA, 477 bp, Homo sapiens
ttccagagccacattttattccaggatgcgacacggggcggcggatgcctggcctcggaaaccccctccctgcctatgagggcttgtccagggctcccctggaacacagctcagccaggcaaggctgggagagggctgggccccccaggtgacctgcagacgcctcccccacctacatgccccacgcaaggggagccctggagcccggcctgccttgacaggaaggagataggtgaaaaataaatacacggctgggccgcctgcagcaagcgcgacagtgcccgggacccccagggccactcctgcctctggtggcctcaccgcggcccaggccctcgtccccaagggttcagacaccactgtcggcgagcaccgtgctgggcgcagaggccacgtgtggtgggacggcagcctgctggcccctccaggtgaggaccaggagcacaggctgtggcaactccagcccgggcaggggcc

SEQ ID NO: 116 - DNA, 555 bp, Homo sapiens
  misc_feature (1)..(555): n = a,c,t, or g
tgctaagcacggaggctgtttataggctgggccgcatattacaatgctcagggctccactgcaccctctcgggggtctgctagcgctttccgtagactgtctccacgccctccccactcccagccagtccacatcctctccggagggactgcagcaaggatcgttaagtctgtccaccgggatgggggaagaccagggccggagcagattggccatccttcagaagatcgacttccgctattggggagagtctgaggagtccgttctcccacggggcctcgtcactctttgcgaagggcgcctggcaggtcaaatgacctccatttccacctcgccttccaccttcttcttttgcttctccatcactgcctccagctctgacactttctctttgtcctccagcagcgagcgctgcacggtgacctggctgtacacacgtgcccnctnctcggggctcaccgcccgcagcttctccctctgcagcgagaaaagctgcgcnccggtcagcacacccagcgcgtccacggtcccggagctaaagcccttggcctgcag

SEQ ID NO: 117 - DNA, 510 bp, Homo sapiens
  misc_feature (1)..(510): n = a,c,t, or g
tactctnnataccccttctttattaataaattttaggtttagctcaatcatttaccggaaaagagagtttgagaatgttcgagaatctctaccactcggtaaccatgctggctgttatatcagaaaaatccataaacatacacagcagcgagctgttttcacaagacttcctgctaataaacacaacactttctcctccactcagatgggagcctcagatgccaaaacgcagatgtgccaactaactataggctcgttgctaagcagagaaacctatcaagtttgtccagcaaattcgattgtacagtgggatggcgtctgctctgcggccttggacagggagccactggtctgtgctgctgtcccctgaggcaggtcgaagctggtggcccttagagggcaggtaaaatggttctcatgggttagaacataagggctttgagaaaaaatgcaaaaggtctcattgaaattggaggcctatgtgaatctgtttacatggaggcataactg

SEQ ID NO: 118 - DNA, 567 bp, Homo sapiens
aatttataaaatatcctttatttattctaaggaacagtcaagcagtagctttaaaaaaaaaaaaaagacacattttttgaaagatattcttagtgttgtgacctggcattgggcccctgtgagcgggacggtggctgagaccgcctgctgtggctttgcgagttctctgcactcactggcaggggtttggtgggaaacggggaagctttggcatggttctgtccagttgcttataatcaagaataatgagttttgaggtttacaaagagcagaagtaacatttatacggctggcatttgacaaaagattgctgataatatactcattccaggaagtgtaaaaatgctttaaaggaatgataatttgtacttactgtttatggggactagatatattagaattatagcatcattatggggacatagtgtttccctataaattcagaaattctctggttgatgtaaaatcatacttcctggttttacttaattagtaaagaaataaataaattagagtaccatttagtcaggtagagttcccctttttccctccttataataaatttat

SEQ ID NO: 119 - DNA, 1506 bp, Homo sapiens
ggtggagcgcacggggcgggcgcacggccatgtccgccgagggcgcggagccggggccggggtccgggtccgggcccgggccggggccactctgccccgaacacggccaggctctgagctggttctgcggctccgagcgacggcccgtgtgcgccgcctgcgcggggttgggcggtcgctgccgggggcaccgcatccgccgggcggaggagcgcgccgaggagctgcggaacaagattgtggaccagtgtgagaggctgcagttacagagtgctgccatcaccaagtatgtggcggacgtcctgccggggaagaatcaaagagcagtgagcatggccagtgcagcgagggaactggttatccagcggttgagtctggtgaggagtctttgcgagagcgaggagcagcggttactggaacaggtgcatggcgaagaggagcgggcccaccagagcatcctgacacagcgggtgcactgggccgaggcgctgcagaaacttgacaccatccgcactggcctggtgggcatgcttactcacctggatgacctccagctgattcagaaggagcaagagattttcgagaggaccgaagaagcagagggcattttggatccccaggagtcggaaatgttaaactttaatgagaagtgcactcggagcccactactgacccaactctgggcaacggcggttcttgggtctctctcaggcacagaggacatacggatcgatgagaggacagtcagccccttcctgcaattgtcagatgatcgaaagaccctgaccttcagcaccaagaagtcaaaggcctgtgcagatggcccggagcgcttcgaccactggcccaatgccctggctgccacctccttccagaatgggctccatgcctggatggtgaatgtccagaacagttgtgcctataaggtgggcgtggcttcaggccacctgccccgcaagggttctggcagtgactgccgtctgggccacaatgccttctcctgggtcttctctcgctatgatcaggagtttcgtttctcacacaatgggcagcacgagcccctggggctgctgcggggcccagcccagctgggtgtagtgctggacttgcaggttcaggagctgctcttctatgagccagcctccggcatagtgctctgtgcccatcatgtgtccttcccggggcccctcttcccagtctttgctgtggccgatcagaccatttctatcgtccgctgacctctggccacaggaagccaggtccaccgcccaccaccctttcaggccatgtttctactcagtgtgcttttcccaaatgatgtgtgtggtgtttctaagagaaacagggcccataaccagtgggcagctttaggagggatggggatctgtttcagatctaggcataacctgtaaatcacaggtgtccaaacttttggcttccctgggccacatttgaagaagaattttcttgggccacataaaataccctaacgatggctgatgagct

SEQ ID NO: 120 - DNA, 942 bp, Homo sapiens
cgtctttggttatgctagtatcagtcagatgcacttagagtgaagaaacactgtaattacagcacacagattgcaagtattgcgtaccaagtgatacaactcgaaatgcagttctcatcttcctgtttggagcaacatgattattttatcacgcatcagagccttcgtgcttggattatctggtatgttaacaattctagaaaacattcatgaattcacaaaaatacgttactatggcaggggaccattttgtacacatttaagtatataaaaatactaaaatattgtccttttataaccaaagtcacgggtatcttcaggtccagggaactagactaggtcatccgtgtacaatggactggtagttacagtcttaggttaaagtattctaatgaagtatgggaactaaatggctggttttctaagataagatatgggatatgggtcatataacttttatattttcatgaagttgatttgtctggtgtgtcatttaaatggtatcattgaagatgtattttagaccaaaggaattaaattttatatttgtcaaacaagcaacacacaaacacacaaaaaacttttctgacgacgtagagcctcgtgaagaatttacaaaccatctggttggcgcccagagccctatgatgatatgacatgcggcacaaagtggaccaaagaaacctggaaaaaatagtgtgggttccccccaaaaaaaacccgcgcggggccaacaacctgttcttaacaaacccccagggggtcgctgagcgaacacgggggctaaaccagagccaggagcataatagacgacagagccagcatactgtctaacgaaaacaaactgaaacacagcaaacgacgaagacatccacgacagcagaaagcgcaaaagaaaaaaaaagacgagagaagacacaaagaacgacaagagcagcagaa

SEQ ID NO: 121 - DNA, 1335 bp, Homo sapiens
ggagagtgcggggggcggaggctggcagggggcgctggaagctggagcggtccgtgcgctccccgcgcccgagggtgcaggaggctctgaagcggctgctgcaccgcggggcccaggcggcggctggggggctggggggcgctgccgccgccgccgccgggggcgtcgctggcctcggcccctttgttctcgcgcgctccccctcgccgcccactcccctgctgtcgcgcggcggcggcggtggcggcggcggctcctcccgcccgaggcagtcgggctcggcgccgggggcgggagggggcggggggagcacgccagccgccgagagtggggggcgatggcgaagctccgggtggcttacgagtacacggaagccgaggacaagagcatccggctcggcttgtttctcatcatctccggcgtcgtgtcgctcttcatcttcggcttctgctggctgagtcccgcgctgcaggatctgcaagccacggaggccaattgcacggtgctgtcggtgcagcagatcggcgaggtgttcgagtgcaccttcacctgtggcgccgactgcaggggcacctcgcagtacccctgcgtccaggtctacgtgaacaactctgagtccaactctagggcgctgctgcacagcgacgagcaccagctcctgaccaaccccaagtgctcctatatccctccctgtaagagagaaaatcagaagaatttggaaagtgtcatgaattggcaacagtactggaaagatgagattggttcccagccatttacttgctattttaatcaacatcaaagaccagatgatgtgcttctgcatcgcactcatgatgagattgtcctcctgcattgcttcctctggcccctggtgacatttgtggtgggcgttctcattgtggtcctgaccatctgtgccaagagcttggcgatcaaggcggaagccatgaagaagcgcaagttctcttaaaggggaaggaggcttgtagaaagcaaagtacagaagctgtactcatcggcacgcgtccacctgcggaacctgtgtttcctggcgcaggagatggacagggccacgacagggctctgagaggctcatccctcagtggcaacagaaacaggcacaactggaagacttggaacctcaaagcttgtattccatctgctgtagcaatggctaaagggtcaagatcttagctgtatggagtaactatttcagaaaaccctataagaagttcattttctttcaaaagtaacagtatattatttgtacagtgtagtatacaaaccattatgatttatgctacttaaaaatattaaaatagagtggtctgtgtt

SEQ ID NO: 122 - DNA, 554 bp, Homo sapiens
  misc_feature (1)..(554): n = a,c,t, or g
aacttgacatttgctttatcctatataatacaaacataacaaaatacatttaaaatgttgttgaaatatacaaaaatttaatgtaatttttgcgtctgagatgtttaaataagaaacttctttaatcaggtatccctttggactgcaagagcagtttatatcatagctttgcagcataatctttttactctcaggctcttcaagcatttttatcttctttgaaacttctatctaaacaaaaatagtattaaaaaagataacagaaggggttagattctgccaatgaactgtggacatcagtatctcattcttctatttgcctccttattctagtttgaaaaagctttggaacacattattacctatcattattacatatttcttgtagctttagtggttactcccccgactggaaatagaagttgctctttaataagggcccaggggtgcctagggagcaatgcgaggattttttccctacatcncctggggccaaccctataccactaattctggggaaggggatggttataatacaccggccctggaaaggt

SEQ ID NO: 123 - DNA, 943 bp, Homo sapiens
ggcggcggcggcggcactcttgggcgcggtgcgtggtgactgagctacgagcctggcggcgggtgtgcgccgagccccggcccggcccgaccctcgcgtgcctcccaggctccgcacccctgatgctgcgcgggtgctgagccccttcggccgggacgatggtgaagtatttcctgggccagagcgtgctccggagttcctgggaccaagtgttcgccgccttctggcagcggtacccgaatccctatagcaaacatgtcttgacggaagacatagtacaccgggaggtgacccctgaccagaaactgctgtcccggcgactcctgaccaagaccaacaggatgccacgctgggccgagcgactatttcctgccaatgttgctcactcggtgtacgtcctggaggactctattgtggacccacagaatcagaccatgactaccttcacctggaacatcaaccacgcccggctgatggtggtggaggaacgatgtgtttactgtgtgaactctgacaacagtggctggactgaaatccgccgggaagcctgggtctcctctagcttatttggtgtctccagagctgtccaggaatttggtcttgcccggttcaaaagcaacgtgaccaagactatgaagggttttgaatatatcttggctaagctgcaaggcgaggccccttccaaaacacttgttgagacagccaaggaagccaaggagaaggcaaaggagacggcactggcagctacagagaaggccaaggacctcgccagcaaggcggccaccaagaagcagcagcagcagcaacagtttgtgtagccagtctaccaccaccacagcaccccagacagctaggcttagcccctctgccctcccttcattgtactttatcattaaaaatcaacttccagccctgaaaaaaaaaaaaaaaaaaaaaaaaaaaa

SEQ ID NO: 124 - DNA, 1244 bp, Homo sapiens
cagagggtgttagggctgtgtcgtgatgatcactatcatggagtcatttcttgtagggaatagttagagggtaagatcagagataggtacttagttcaagaagactctctgaagctcccaaactgtagatatgtcctgtgtgcgaactggctggctttacagaagtcctgatggaagtgggtttattgttttttgactcgttaccaaccctctgcttactccttcccctcaaaaaagggaagctgacttctcaggttagccagcagctcactcatacttttttctctctctattccattggctgatctgctgacttggggctctgaatctggatactctccatcaccggttggctgctgtcaccatttccttcctcgttgatggcactactagtggtcaagcagaggatgcagatgtacaactcaccataccaccgggtgacagactgtgtacgggcagtgtggcaaaatgaaggggccggggccttttaccgcagctacaccacccagctgaccatgaacgttcctttccaagccattcacttcatgacctatgaattcctgcaggagcactttaacccccagagacggtacaacccaagctcccacgtcctctctggagcttgcgcaggagctgtagctgccgcagccacaaccccactggacgtttgcaaaacactgctcaacacccaggagtccttggctttgaactcacacattacaggacatatcacaggcatggctagtgccttcaggacggtatatcaagtaggtggggtgaccgcctatttccgaggggtgcaggccagagtaatttaccagatcccctccacagccatcgcatggtctgtgtatgagttcttcaaatacctaatcactaaaaggcaagaagagtggagggctggcaagtgaagtagcactgaacgaagccaggggttcagatgacactgctgcatcctggtcacattctctgtctcctggaatgctcccacctcaagtggagttagaaggaaggtagaggggctctcccccaggattttggtgttttgactaacaccagttcctgccaacctctgttgccaccacctttccttccaggccctaagcacgtgcagcaaagcacaccacagcacctttgataacctctctccatcctgggcctgatgacctgctctagactgttatagagggataagcagctcattcccctggttcctaataaaaagcctttaaattaaaaaaaaa

SEQ ID NO: 125 - DNA, 5142 bp, Homo sapiens
gaattcggccgagaggacgagggggagggccagagctgcgcgtgctgctttgcccgagcccgagcccgagcccgagcccgagcccgagcccgagcccgagcccgaacgcaagcctgggagcgcggagcccggctagggactcctcctatttatggagcaggcacccaacatggctgagccccggggccccgtagaccatggagtccagattcgcttcatcacagagccagtgagtggtgcagagatgggcactctacgtcgaggtggacgacgcccagctaaggatgcaagagccagtacctacggggttgctgtgcgtgtgcagggaatcgctgggcagccctttgtggtgctcaacagtggggagaaaggcggtgactcctttggggtccaaatcaagggggccaatgaccaaggggcctcaggagctctgagctcagatttggaactccctgagaacccctactctcaggtcaagggatttcctgccccctcgcagagcagcacatctgatgaggagcctggggcctactggaatggaaagctactccgttcccactcccaggcctcactggcaggccctggcccagtggatcctagtaacagaagcaacagcatgctggagctagccccgaaagtggcttccccaggtagcaccattgacactgctcccctgtcttcagtggactcactcatcaacaagtttgacagtcaacttggaggccaggcccggggtcggactggccgccgaacacggatgctaccccctgaacagcgcaaacggagcaagagcctggacagccgcctcccacgggacacctttgaggaacgggagcgccagtccaccaaccactggacctctagcacaaaatatgacaaccatgtgggcacttcgaagcagccagcccagagccagaacctgagtcctctcagtggctttagccgttctcgtcagactcaggactgggtccttcagagttttgaggagccgcggaggagtgcacaggaccccaccatgctgcagttcaaatcaactccagacctccttcgagaccagcaggaggcagccccaccaggcagtgtggaccatatgaaggccaccatctatggcatcctgagggagggaagctcagaaagtgaaacctctgtgaggaggaaggttagtttggtgctggagaagatgcagcctctagtgatggtttcttctggttctactaaggccgtggcagggcagggtgagcttacccgaaaagtggaggagctacagcgaaagctggatgaagaggtgaagaagcggcagaagctagagccatcccaagttgggctggagcggcagctggaggagaaaacagaagagtgcagccgactgcaggagctgctggagaggaggaagggggaggcccagcagagcaacaaggagctccagaacatgaagcgcctcttggaccagggtgaagatttacgacatgggctggagacccaggtgatggagctgcagaacaagctgaaacatgtccagggtcctgagcctgctaaggaggtgttactgaaggacctgttagagacccgggaacttctggaagaggtcttggaggggaaacagcgagtagaggagcagctgaggctgcgggagcgggagttgacagccctgaagggggccctgaaagaggaggtagcctcccgtgaccaggaggtggaacatgtccggcagcagtaccagcgagacacagagcagctccgcaggagcatgcaagatgcaacccaggaccatgcagtgctggaggccgagaggcagaagatgtcagcccttgtgcgagggctgcagagggagctggaggagacttcagaggagacagggcattggcagagtatgttccagaagaacaaggaggatcttagagccaccaagcaggaactcctgcagctgcgaatggagaaggaggagatggaagaggagcttggagagaagatagaggtcttgcagagggaattagagcaggcccgagctagtgctggagatactcgccaggttgaggtgctcaagaaggagctgctccggacacaggaggagcttaaggaactgcaggcagaacggcagagccaggaggtggctgggcgacaccgggaccgggagttggagaagcagctggcggtcctgagggtcgaggctgatcgaggtcgggagctggaagaacagaacctccagctacaaaagaccctccagcaactgcgacaggactgtgaagaggcttccaaggctaagatggtggccgaggcagaggcaacagtgctggggcagcggcgggccgcagtggagacgacgcttcgggagacccaggaggaaaatgacgaattccgccggcgcatcctgggtttggagcagcagctgaaggagactcgaggtctggtggatggtggggaagcggtggaggcacgactacgggacaagctgcagcggctggaggcagagaaacagcagctggaggaggccctgaatgcgtcccaggaagaggaggggagtctggcagcagccaagcgggcactggaggcacgcctagaggaggctcagcgggggctggcccgcctggggcaggagcagcagacactgaaccgggccctggaggaggaagggaagcagcgggaggtgctccggcgaggcaaggctgagctggaggagcagaagcgtttgctggacaggactgtggaccgactgaacaaggagttggagaagatcggggaggactctaagcaagccctgcagcagctccaggcccagctggaggattataaggaaaaggcccggcgggaggtggcagatgcccagcgccaggccaaggattgggccagtgaggctgagaagacctctggaggactgagccgacttcaggatgagatccagaggctgcggcaggccctgcaggcatcccaggctgagcgggacacagcccggctggacaaagagctactggcccagcgactgcaggggctggagcaagaggcagagaacaagaagcgttcccaggacgacagggcccggcagctgaagggtctcgaggaaaaagtctcacggctggaaacagagttagatgaggagaagaacaccgtggagctgctaacagatcgggtgaatcgtggccgggaccaggtggatcagctgaggacagagctcatgcaggaaaggtctgctcggcaggacctggagtgtgacaaaatctccttggagagacagaacaaggacctgaagacccggttggccagctcagaaggcttccagaagcctagtgccagcctctctcagcttgagtcccagaatcagttgttgcaggagcggctacaggctgaagagagggagaagacagttctgcagtctaccaatcgaaaactggagcggaaagttaaagaactatccatccagattgaagacgagcggcagcatgtcaatgaccagaaagaccagctaagcctgagggtgaaggctttgaagcgtcaggtggatgaagcagaagaggaaattgagcgactggacggcctgaggaagaaggcccagcgtgaggtggaggagcagcatgaggtcaatgaacagctccaggcccggatcaagtctctggagaaggactcctggcgcaaagcttcccgctcagctgctgagtcagctctcaaaaacgaagggctgagctcagatgaggaattcgacagtgtctacgatccctcgtccattgcatcactgcttacggagagcaacctacagaccagctcctgttagctcgtggtcctcaaggactcagaaaccaggctcgaggcctatcccagcaagtgctgctctgctctgcccaccctgggttctgcattcctatgggtgacccaattattcagacctaagacagggaggggtcagagtgatggtgataaaaaaaaaaaaatcatcagcaataagctgatagatggactttccactgtaggagtggacgtttcaagccaactgagccttttcctcaagtgccgacacctccctcatctctcttatagtggaaggatggtcagcattaggctgatggggactgagaaggataggaagggatagaaattgccatgtgtataaagctttattctttagcccttaaccctaaggctcagggaaataccctatgttattgtgctccctggattcctgcaactcattttccttccactctggagcagggtgaggggaatgttatgggtaacagacatgcaggcatggctctacccatttctttgcacaagtatggggcccatgtggtagtccccatacccctccagttcctatatttttgtcttcttcctttcccctctttgccattcctaccttgcatttttcctgtcagtgccttagccaaggcaaggagataaggatgctcttcttgctttttatatctgcacattcatacctctccaaagaccagcttttccccagccagggccctcagccttccctgctgccccagtgattgattgagagagctgttggggtttctctgccaatgacccctgggagagggactttggtagggtcatgataaagtggcgggggtcttggtcctgctcagggttttcatccttcctcctctccctcctctgtgactgtggatatggttataaggtggttgcacctgggagccctgacaactggctgcacaaattccaaaagtaaaggtgtcagtccctgtggccttccttggggcttctctgaccacatgtgcccaacttcaataagagaaccaagggaccttcattttctgaggtgcttggctctgattcagggctttgcaaggggttagaagctgactgtaaaaatgggaagaggcaacggaagacatttatttctcctttggattttggggagaaccaagccctggtagggaagaggtaagggggatgattcacctccatatttcctaagcaggttgtatagggagccggtggcaggaggaaggctgttttcacaaatgacttgtaatgtcgtgattaaaaaaattcctatattcttctgcaaatcaaacgttctttcccaatccaatccagccttggttttattttaaattaaatattaaaattacacatttatattgaaaaaaaaaaaaaaaaaaaaaaaaaaaaaaaaaa

SEQ ID NO: 126 - DNA, 424 bp, Homo sapiens
tttttcaggaggcagcatcagatttatttattcctactcaacatgacccgggaacacaggagcaactctgtacacttctagaaactcacagctagctccaaaacaatagaaattttaaactacaaaagatgagttgtattcagcaaatataaagggtaattttagactgtgtgaacgtttatcagactatttacagcacccgggagacgggttcagatctcgccggcctccttctcttctgacctccgtgaagccatcttcccgttggagctctcaagcctccagtccgggggccctcgctcgctccgcccgctctcccaggactcctctctggatgcccgctctctggagaacctgggaaatgggaaccagaggctcagtggaggctgctgccccccttctgctggccgctcaggcactgacg

SEQ ID NO: 127 - DNA, 2286 bp, Homo sapiens
ggaggcaaacgcacgcgggaagagctgctacccattccagggaccctgccgctgcccctctgaggggtctgcacctcctgggagcaggtgggtctctgggacgagggtccatggtggatggctctggagacgctcccgaggctgtgccgtccccctgctgcacaggtcggagggtcaccgcagaggctactcgggctggggctggggccgagggagcccgcactggagccccatgtggaacccaaggatgcagctgctctgctaacacggcagcccatccttcgagactgtgacctcgccacagtggccctcagccctccacctccggcgggggcgagggccacccacctccaagtctccagccatgacgacctccgcactccggcgccaggtgaagaacatcgtgcacaactactccgaggcagaaatcaaggtgcgcgaggccaccagcaatgacccctggggcccccctagttcgctcatgtccgagatcgctgacctgaccttcaacacagtggccttcaccgaagtcatgggcatgctgtggcggcggctcaatgacagcggcaagaactggcggcacgtgtacaaggctctaacattgctggactacctgctcaagacgggctccgagcgggtggcccaccagtgccgcgagaacctctacaccatccagacactcaaggacttccagtacatcgaccgcgacggcaaggaccagggcgtcaacgtgcgcgagaaggtcaagcaggtgatggccctgctcaaggatgaggagcggctgcggcaggagcgaacccacgccctcaagaccaaggagcgcatggcactggagggcatcggcattggcagtgggcagctgggcttcagccgccgctacggcgaggactacagccgctcccggggctccccgtcctcctacaactgcccggcctcagacgtcaggggaagaggaactgcagctgcagctggccctcgccatgagccgtgaggaggcagagaaggaggtgaggtcctggcagggtgatggctcccccatggccaatggtgcaggggccgtggtccaccatcagcgggacagagagcctgagagagaagagagaaaggaggaggagaagctaaaaaccagccaggttttaggccgaacacagaggccagtggatcctcctgggggccttctgcagacccctggtctccgatcccctcaggaaccgtcctgtcccgaagccagccctgggatccgactcccatgctctcctcctctgagccctggggcaggaccccagtgctgcctgctgggccccccaccacagacccctgggccctgaactctccccaccacaaactccccagcactggggctgacccttggggagcctccctggagacctccgacacacctggtggtgcctcgacctttgacccatttgccaaacctccagaatccacagagaccaaggaggggctggagcaggccctgccctctgggaagcccagcagccctgtggagctggacctgtttggagaccccagccccagttccaagcaaaatggcacgaaggagccagatgccctggacctgggcatactaggggaagcactaacccagccaagcaaagaggcccgagcttgccggactcccgagtccttcctgggtccctcagcttcctccttggtcaaccttgactcgttggtcaaggcaccccaggttgcaaagacccggaaccccttcctgacaggtctcagcgctccgtcccccaccaacccgttcggcgcgggcgagacgggcaggccgacgctaaaccagatgcgcaccggctcgccggcgctgggcctggcaggcgggcctgtgggggcgcccctgggctccatgacctacagcgcctctctgcccctcccgctcagcagcgtgccagctggcttgaccctccccgcctcggttagcgtcttcccgcaggccggagccttcgcaccgcagccgctgctgcccacgccgagctcagccgggccgcggcccccgcccccgcagaccggcaccaaccccttcctctgagccccgccccgtcccataccggcctgcgcctgcgccggacgctccgcggccccgcctccggacccggggctgggcggggcgccggtgctagtggaacgccgagccagtggcggctggtatcccgcggcggctctggaagctggacgcggaccacggcccgggagctagaaactgaacgcccgcataataaagactggaaccctcgttaaaaaaaaaaaaaaaaaaaaaaaaaa

SEQ ID NO: 128 - DNA, 1191 bp, Homo sapiens
cgaggcggcggcggcggcggcagctgcttgggcgcggtgcggtggtgactgagctacgagcctggcggcgggtgtgcgccgagccccggcccggcccggccctcgcgtgcctcccaggctccgcacccctgatgctgcgcgggtgctgagcccgcttcggccgggacgatggtgaagtatttcctgggccagagcgtgctccggagttcctgggaccaagtgttcgccgccttctggcagcggtacccgaatccctatagcaaacatgtcttgacggaagacatagtacaccgggaggtgacccctgaccagaaactgctgtcccggcgactcctgaccaagaccaacaggatgccacgctgggccgagcgactatttcctgccaatgttgctcactcggtgtacgtcctggaggactctattgtggacccacagaatcagaccatgactaccttcacctggaacatcaaccacgcccggctgatggtggtggaggaacgatgtgtttactgtgtgaactctgacaacagtggctggactgaaatccgccgggaagcctgggtctcctctagcttatttggtgtctccagaactgtccaggaatttggtcttgcccggttcaaaagcaacgtgaccaagactatgaagggttttgaatatatcttggctaagctgcaagccaaggaagccaaggagaaggcaaaggagacggcactggcagctacagagaaggccaaggacctcgccagcaaggcggccaccaagaagcagcagcagcagcaacagtttgtgtagccagtctaccaccaccacagcaccccagacagctaggcttagcccctctgccctcccttcattgtactttatcattaaaaatcaacttccagccctgtctgctgtctacgtggtgggttgtggggatgcagtttggcatctgcagtacaccaagcacatgattcatgtctgagccaggtctgcttattctcccattgggcagctgaggaccgaggcacagaggtgcggtgacttgcccggggctccaggtagcctgcaggttaactggcggtaagtgctagactgtaagcccgacaagggcagggcttttggttttgttctctgatgtgtctcagtatctagcacataatagacactcaataaatacttgttgaattcaaaaaaaaaaaaaaaaaa

SEQ ID NO: 129 - DNA, 1853 bp, Homo sapiens
tgtgtctctcccgaccatggagggggtcgcggtggtgacggcgggcagcgtaggcgctgccaaaaccgagggagctgcagccttgccgcctccgcctccgcctcctgtctccccgcccgccctcacccctgcacccgcagcgggtgaggagggaccggcgcctctgtctgagacgggggctcccggctgctccggctcccggccccctgagctggagccggagcgcagcctgggccgcttcagaggccgcttcgaggacgaggacgaggagttggaagaagaagaggagctggaggaggaagaagaggaggaggaggaggacatgagtcacttctcgttgaggctggagggaggccggcaggactcggaggacgaggaggagcgcctgattaatctctctgagctgaccccatacatcttgtgttccatttgcaaaggttacttaatagatgcaactaccatcacagaatgtcttcataccttttgtaaaagctgcatcgtaagacatttttactacagcaacagatgtccaaaatgcaatatagtagtacatcagacacaacctctttataacataaggttggaccgacagttacaagacatagtgtacaaattagtgatcaatctagaggaaagagaaaaaaagcaaatgcatgatttctataaagaaagaggtctagaagtacctaaacctgctgttccacagccagtcccttcaagcaaaggaagatctaaaaaagtcctagaatcagtgtttcgtattccacctgaacttgatatgtctttattactggagttcattggtgctaatgaaggcacgggacattttaagccattggaaaagaagtttgttcgagtttcaggagaagcaactattggacatgtagaaaaattcctcagaagaaaaatgggtcttgatccagcttgtcaggtagatataatctgtggtgatcacctgttggagcagtatcaaactctaagggaaatccgacgtgcaataggtgatgcagcaatgcaggatggtctgcttgtccttcattatggtcttgtggtttctcctctgaagataacttgaagattctaggcacattatgaggagggaaacaaaggaggcttctgcaggactgcatctcaccaaagatttccatgaaatgtaattgctaccactttgctgttcaagacataacttacctatttttagcaccaagaattatagcgtttataagtacaacttggaacgatggaatgcatctgttactagagactgtatataaaaagcagccaaagctcaggggaaatttttcaaaaattgaattttaaaatttcttatgattttaaataccttgacattgattttgcttcccatctttgaagtaattggttagttttctttgttcagccatttcaagttggtggttgggatatctgctctctgggatggcatcagttgggcagtcatctttttggaagagaagtgtgcttttgagtggaagattcaaagccagtctttgttaaactgcagggtgtactctcaaagaccaaaactattggccacttttgtatgttgccagcatattttgaacttgtacctttttttatactagcaacactacaaaggagaagttactcatttcaaaatggatgaattgttattatgtgtgaagagactctgattttatgatctgtgccataaaatttcagtgtaataagacttcttcaatacatcttccaataaggggtgcttctttgtgacagtatttttatttctgacattcattttatttgggtacatagtgtggttgttgataccttgcaacagtattgcttctgaaagtaataaaaaattttaggag

SEQ ID NO: 130 - DNA, 805 bp, Homo sapiens
  misc_feature (1)..(805): n = a,c,t, or g
tggcgtctgggatgtactttattggacaagtggtggcccaagtcttggtctggaagcactggggccctggaccaggcactgagtttgaggaggcccagagttcagggctgtttggagcgaggccacaagcggctggtgagggagccaaggaagaggttctgcttgttggacttggagagctcggccaggcgctgctgctcctcctgctctagccggctttggcctgtttgaaagccgccagcgggtcatcctccagggcatagtgctccagcagggttcgcacgtcctccacaccattcagtgcaatggtcttgaggaaggcagacagatccaacaagacccggtcatcagagttgccgtcccagggccgcagggcaacgccgttatagggctgcaggcggaaggcttccttcttgcagtccacaactactactcgagctgggtcccgattcagacatgaaatatcctttacatggtgtccatccatgtatcttgtggcgtcccggaataggcggtaggagatgaagccatgggggtccacactatcaatgagtggaaacgcagtcatgccagtctctgacgtaaagatgacaatttcatataaaggggcagctgctggaacaggtctcgatgcctggcgcttcttanacctccagcagtgccagcaaccactcaggatgcagaggacgcggtgagctcaaaacgagcgtgtagggtggcttgtagtacggttctgcagagggtctgggagaaggcaagggctggtgggctcgatgatcatctgtctcatatctttgaaaatatt

SEQ ID NO: 131 - DNA, 1070 bp, Homo sapiens
attaatctatttaatttttttttttcagtttgtattttttattttacaataaaaagtcaaaaaaaataagcaaaaagataaactggaaaataagayttacatctcatatatatggacaaaggaccaattacctccaaacataaacagctcctagaaattactgcaaagatcaacaacccagtagaaaaatgaatgaagttcccagaacagaaaacacaagtggcccttcaaaaaaatgaagagaggctcagcctcttatggtaagacaaagagacaggattttaaaaacctaggcctcttcctagagttcccttaaatatctaggccagatcatttttacttcctggcttagaccctgccaagggctgcccagctactcaggtgtttgtgtacttgtggactcaagtyatattgtcctgatcttctggctgagtacggttttctcctccagcaaagacaatttggaggatgtactaagcatgaagcgctacttcctggcccccatctctcttcgcacagtgttccatcatccagccatgaaagcacagctgagtgatccaagaggcagttccaattgttgactaacgtgtacctgcctatgtgagtgtgttctatgggaactcaggccttagaatggtttcaaagtagtggctttcaaaattactgtttgcctcttcaaacttcacacctaaggaaaatggaaacatgcagagcagggacacagaaggggcattagctggcgtggggtaggggcaagagctaattgtgaaggaagaaggcctgagatcacgtagccatgtcggagaacagctgtgctcgctgccctgcctctttgcgcgcatgttaggcagccccaggctccagctgcttgagtttctcttggagtgcccggagctggcttcgaccccagttaatgcggttctggaaaaaaaaaawatwtrcggscagctgcaggscatcccggaagcttgcttgagcttgaggtgactgttaggactwgggttccaaccmgttcagggggtctgaggggctaaaagrctcsgktctggggttaatgggccytkccctcc

SEQ ID NO: 132 - DNA, 840 bp, Homo sapiens
cgcgggccgcagggcatggaccttcaggccgccggggcccaggcgcagggggccgcggagccgtctcggggcccgccgctgcctagcgcgcggggggcgccccccagcccggaggctggctttgctacagctgaccactccggtcaggagagagagactgagaaggctatggatcgactagcccgtggaacacagagcattcctaatgacagtcctgcccggggtgagggcacccattctgaagaggaaggctttgccatggatgaggaggactctgatggagaactgaatacctgggagctgtcagaagggacaaactgtccacccaaggaacagcctggcgatctttttaatgaggactgggactcggagttgaaagcagatcaagggaatccatatgatgctgacgacatccaggagagcatttctcaagagcttaaaccttgggtgtgctgtgccccacaaggagacatgatctatgaccccagctggcaccatccgcctccactgataccctattattccaagatggtctttgaaacaggacagtttgacgatgctgaagattgagtgtggagctttctgccttgtaggtgggcgggcctccacgtcaagatctcttttcctgtcttggaggtgaaaagtcatatctgagaaaatgtttgcagtgacccctagtctggggtacacagaccagtgttccttattgacagtgttcaataaggccccgtcattctcgccagtctgttgttgttcttaatgggctcctccttgaaatgtgtgtgtgtttgtgtcaagaggagttgtgttctttgtaaataaaggttaaaaagagaaacc

SEQ ID NO: 133 - DNA, 1187 bp, Homo sapiens
cggacgcgtgggtcgacccacgcgtcgcgttgaaggacaccagctgcggaatttgcggctgtggcagatggaaatcatggcaggtccagaaagtgatgcgcaataccagttcacgtggtattaaaaaatatttcaactcttatactctcacaggtagaatgaactgtgtactggccacatatggaagcattgcattgatggtcttatatttcaacgttaagggtccaaaaaaactccagctgtgaaagcaacataaatggattttaaactggtctacggttcttaacctcatctgttaagttcccattgcctggagaagctaagtgccaagctcatcatgtgactacttcaattggtacaataaattatgaacctggaacaacaaaaaaacaacacaaaaaccaacaaacaccacaccaacacaaaaacaaagcaaaaaaaaaaaaacacacaacagcgggcgaacaaaacaagaactaccgcggggcgccccacacagaaaacgcacaccgaccctctccccaaaaagcaccccccaaaacacaaggacaccaccccaacaccacccaccccgaccagcaaccgcacacccacacacaaacaacgcgaacacgaaacaacccacaacaccaccacaaccacacgacaccaacacaaccacacaacaccacgagcgccaccacacaaaacgcgccgaaacacacacaccacacccccacaccccccccccacacgccccacaccacacacacacccaccagcaacaacacgcgcgcaaaaacaaaacgacaaacccaccaccagcgcgaccagacgaccaccgcccacccccggcccacccgacaagcaaacaccacaatcaaacccgaggcaggcaccagaaaaacaacacagacaaccccccacaaccaccacaaccactaccaccacgcgcagcacccaccaacacaacacgcacgagcgcccgcaagacaaagcgccacgagcccccagagcaacaagaggacggagagcagagaagacacgcgaagacaacaacaaacaaaagcgacaccgcaacacgagacgcaaccgcagacccaccgccgcgccaccgcagccgaaccagcagcgaacacagcgcagaaaccaacacacacaagcgaaagcccgcacacgcaggagaggagaagaggaaagcagaacaa

SEQ ID NO: 134 - DNA, 569 bp, Homo sapiens
ttttttgcaagatttaattcttcctttaatataaataaggcagcatgaaacaccaagagccccactgctttctgctttagaagcagctttggtgcagaaaagattcccgtttccccaccgagttctgttgtctctgtacacacaagaagccagaagatatttttttttcagtgaactttctcctggaagcaaaggagaagctatgggagatccaggcatggttttggcttctggaggctgttttttggttactggggtctcttcaaagcaaaacgggatcaggatgaagagggggaaaggcatgggccataaataaataaggaaatttgccccgattctacaaatgcatctgatggaatgaggagggtcaggctgtgagggattgggggtagctccaggctgctgttagggacacacttgagctggttcattccctggagtgccccgcaactgcgtctagggagaggcaggcccaagcacatgttcagtctaattccagctcacactggaaggcttcctataggtttggttgccctgatcacagccgagctgccccaccaggaattaac

SEQ ID NO: 135 - DNA, 596 bp, Homo sapiens
ttataaagacagctataaagacagcactttccgcacacaaagtgtattttacaaaccttttttatacaaattaatgagctctactttatttaagtgttcatggaatgatgtaaattttaggtccagttgaacaaatattgagtgcctatcatatgcaagactaactccttactaggaatgaaatcacacagtgtcttctgtttgcagtatgtgaactttatgtttgaaaagaaattattatatttaaatttttttgttgtcagagtttatcattgtatactgtaacccagtaaattttgcattcagttttaaaaaatgaagatgtaacttacctgagtctcatttttgaaaatgaaattctgcaaaaattatttaaaaattagttcttggggaaattgattttcaagattcaagtgtataaaaacttatattgaacttttcagcctcgtttttaattagctgatgttaatgataagatacataatacatgtatcttgttgctgaaaatattttttgcatttcaacacattgagttaaaataaagttgttactacttattcaagattaaaaaaaagaaagaaaaaaataaaaaaaga

SEQ ID NO: 136 - DNA, 583 bp, Homo sapiens
  misc_feature (1)..(583): n = a,c,t, or g
cacgaggcgcaaangactttttttttttttttttttttttcactagacaaaaatctatttttaattgtataaaattatacatataaaatacatagaatgtactaagaagatgagtaaaatctttgacaccagaagtggacagatcaggaaacaatttttctcaagttatttgggatcttactggttggtatttgagaaaaataataaatccaggaggtacgagggcaattcttcccacaactcacaccccttaatccacacgtcccagagaaaggagaaacaggagtgttgatgagtgccagcttataaatgtcaaacagacacacctggtgtgtctagctgtttttgcctttactccaacccgacgtgtttcatggaatacaaacatggggcttctaccccagctctcttctgattagtaagaaaaaaaaaatgatagggcctggagaattcaaggaagcccgtttcaagcactaataaaattgtagctggattccttacctcttacccaacatgatttcaaaagcaagaaagttgcctttcatcttgcccctatcaaatccaaaagagccaattatagcct

SEQ ID NO: 137 - DNA, 672 bp, Homo sapiens
  misc_feature (1)..(672): n = a,c,t, or g
gctggccggcgtcacgagaccacatccagcattgccagcctcatctgacggagccagagccgtccttcttctcacagcggcctcagcgtccccagagccgagccagggtgtgagtgcatgtgaacgttgagtacacatgagtgcgtgtatgcccccaggctgggtcagctcttctgtggattgcatggcgtgtgattaaaagcccatgtgttcccacacatccacatcatgggaaggctaatgtgtgcctccttggaactgggtgttggtgtccatggaacttcctctctgtatctcatgtcagtaggcgcagaaacgcctcatgatgaagattcttgagccccatttacaagacccctcacatccaatcctgtcctgtaacatccatcaaggatttccataggggtgactggtgcccacccaagactgcaccagtgcctgctcattgaagagagtaactgctggccaggcagaaagaatatgggctctgcaatgagacagacctggaggggactctaccgttgagcactagcagctggaggagtggggagttcatggctatcatggttgtgataatcgattgtggngatgaaatgtcattgtgtatggaacgcggngctcattgctgattggcaataaaatggcggctgccgttgcatcggcaaaagggga

SEQ ID NO: 138 - DNA, 615 bp, Homo sapiens
tttttttttttttttttttttttttttttttttttttttttttttttttactaacagtgtttttatttacaaataattgtttttattaggccatttggaaaaccactaacattttttattttagaaaacattaaataataaacaagatgttatacagtactttggataacttcttccatcagtttagtgcaatgtatcattggcatcgaaaagtaaaattttcatttattttcccctttcatcttcagctgtgcagttatatgaccataaaggaaatgaaccattaaaaatggatctacagccatatattctgccgttactcaaaggcttaatgatttattttccccctccagccctgcctttaccaggttaaatgacagaagaccttctattgtacctattgttcaaaaaatattactgttctgtggaacctgggagagtccaattgataagagaaactgaatcatactgatgaggtgaaggaaaggtctgccggtgtggggcagggcactctttctcagcagccaagataacttgtcacacacgaagcagagagaatgccccgatgaaaatctctctgaactgtgttccttgaaggatctcttaaaaaaaaaa

SEQ ID NO: 139 - DNA, 469 bp, Homo sapiens
gaaaagaaaatcccaaagcaaatttgtgctagggttctttgaacttggctcttttacctcatggttgaagatcttgaaagaagtatgtaggataccactgggtgatgtacttgtcaaggccctgaaaagtagcctaccatgccattctcccccactctcaagtagcacttttatgttatgggaatcaaggggtgggaggtatcattattcctggtagttatgggtttttaataaatatcattactgcaatatcagacttcaatcttgccagaacttcaaaaaacattattcaatttttgtcttacgaaacacttaaaaaaaaagactatcacttgagaattttctttgcaatttcctgtaaatgaaaacatttgttaaaaagttcatctatgaaaagttctcacatatcttaaaaaaaaaattcttctgtacacttgttcccataattatgttgaaattaatggaaaat

SEQ ID NO: 140 - DNA, 490 bp, Homo sapiens
  misc_feature (1)..(490): n = a,c,t, or g
ttttgctgatttaaacaaaaatatttactcttttcattagcaaaacattatttaaaatatatctatttctcccctctgaacatttaactaggaacactgggcaatttttgaaggtttagtgctgattgtttaatacaataaatatggctgtggagagcacacagcagcagtagcttacatacgtccacggataagaaatttactctcatctggttagtgtccagtccaccaaaggaaaggtttggcattcgtgtgcttttttttcgtgtaggaatcaattctgcttgattttcattcttggaagaaaaaataatcagctgatatcctcaaattttatgacatgatgcaaaggagcaaggggacaaagatgacctatggtcaaaaagctggactgggatcaggtctccaggcagatcttccttcttgcgaggtgagtctacaaagggctgcactagaagccaggagtgaggcattggggacacnggggtgg

SEQ ID NO: 141 - DNA, 730 bp, Homo sapiens
  misc_feature (1)..(730): n = a,c,t, or g
agccttaaagagatgaaataaattaagcagtagatccaggatgcaaaatcctcccaattcctgtgcatgtgctcttattgtaaggtgccaagaaaaactgatttaagttacagcccttgtttaaggggcactgtttcttgtttttgcactgaatcaagtctaaccccaacagccacatcctcctatacctagacatctcatctcaggaagtggtggtgggggtagtcagaaggaaaaataactggacatctttgtgtaaaccataatccacatgtgccgtaaatgatcttcactccttatccgagggcaaattcacaaggatccccaagatccacttttagaagccattctcatccagcagtgagaagcttccaggtaggacagaaaaaagatccagcttcagctgcacacctctgtccccttggatggggaactaagggaaaacgtctgttgtatcactgaagttttttgttttgtttttatacgtgtctgaataaaaatgccaaagttttaaaaaaaaaaaaaaaaaaaaaaaaaaaaacatgttcgccgcctcggcccagtcgactctagacttcgagcaagcttatgcatgcggccgcaattcgagctcacttggccaanttggccctatagtgagtcgtaatacaattcaattgcccgtcgtttttacaacgtcntggcttgggaaaacccttggcgtaacccaaatttaatcgcctttgcagaa

SEQ ID NO: 142 - DNA, 568 bp, Homo sapiens
  misc_feature (1)..(568): n = a,c,t, or g
agcttgtgaattattttactttcaaaaaatatgtaagttagaattgtaattctaaaggcactgtcgtttgcttacacattctaacatatttctaataagaaagtacctgctttcttaagagaaaaagggataagttaccaaaagcagcacgttctcctgggctcataccccggattcatccatgaggccacttccattgtaaagcttttagcatctcttgatttctcttcacactgaggcacaaaggcctgctacttataggcattacttcatttttccttatgaagggtactataccaacacagactttatagtatgtttaaaaatcccaactgcaagatacacaggatgctgtaggcctgatttcctgttgtagaacctncagccctgtgttgaatgaagaggtgcanatatatagacccttaagatcagaccacagcaggcattcangtggaggggatgaactccattcattccagctgtgcagtgggacatctgcgccctccgcatctncgctcattnctcatctgagccactcaagagggcngnnctgtagtgtcatctgaat

SEQ ID NO: 143 - DNA, 445 bp, Homo sapiens
  misc_feature (1)..(445): n = a,c,t, or g
tttgttgtttaaaagcaaggcatgcttgtcggatgactctgtaacagactaattggaattgttgaagctgctccctggttccactctggagagtaatctgggacatcttagtgttttgttttgtttttttccctcctcttttttttgggggggagtgtgtgtggggtttgttttttagtcttgtttttttaattcattaaccagtgncaanggttagcccttaaggggaaggaggacggattgattccacattccacttcctagatctagtttagaaaacatgttccccatctggtgctcttaggaaggagtatagtaaatgcctcatttaataacatactccntttttgaaaagttgccnttttctctccacccctgagtaagatccagtaatttgatggaacnccagaaagtggggtggaagccaatcntggccccgcccctt

SEQ ID NO: 144 - DNA, 701 bp, Homo sapiens
  misc_feature (1)..(701): n = a,c,t, or g
tttcagcaacctcggctgtatttattgatacaaggaagatcacccgagagtcagggacgtggcggcgaggggccctggaaatctccagataccaaagctggaagggcgtggagtcttctccagttctcctagtttacagatgttgtgacctaggcttacaatgggcctggggtctgaaagcgggacgtgggctgcgggggttaaagagccggtttggtggaggtcagcgccacagcgcgccgngccaggaagactttattctgcgcctccgtctgtctctgacgtttgagctcagagatgaggcgtccgtaggagttagccagagccacagtgtacgccatcaggatgctggagatcagcagaaggggcacagcaaaagcctgggtccccaggaagaagaggaaattctgggtggtctcagggaggctggaaatagactcagggatctgggcccanatggacgactgcccccggaatggaccacacagcttagaaggcgggatcaggaagatgctgtaaagcaggggaacgctggagatggccagacccaggagaaggaccaaggggaaaaagaaattcgccgcggaagcccggaaggtgcgggcagccgggggacaggtggagaaaaaggtaagctttctcaggtaaaaagcagcagggacttgaccgtgttaagccagggcagtaaggggccgaaaaaa

SEQ ID NO: 145 - DNA, 2098 bp, Homo sapiens
acagattgctagaactactttatgcatgaaaaaagtctgtttcactgatatgaaatgttaatgcactatttaatttttttctctttgttgcttcaaaatgaggttggtttaagataataataggacatctgcagataagtcatcctctacatgaaggtgacagactgttggcagtttcaaaataatcaagaagagaaatatccttagcaaagagatgactttggggatcatttgaggaatactaactctgttgcattaatgcttcaaaaaatcatcaaatgattcatgggggcctgattcgcatttgaaaaatgtctgaaattagagtctcatttgtttcaggaatgcagctacctgagttttttgtctcggcaaagtcacaaagcccatatactcacattgtgtgtctatacttgccaattaattctaaacttgtaggaaatatgccctctcttaaaggagaattttttttaaatctctgagaaatgagattctgagtttatttcagctaaaaggttgcaattcttctgaagatatctcaaatataaggttgaaagttaagtgttaataatttttgtgaatttatacacacctaaacgttaagtacacaaatattttatttgttttacaaataaggaataagtaatttataaattaagaagttacctataaaaataaaaagataacaaccctatcatatagcttatttttaaattacctgaaaaacgatattctacactgtttcctttttgactctgagttttcaaactgttacttctcccatatttctcaatccatttcactcagttgcacagtcttttaaaccctgtaattgtcataccaaagtttctttttaaaaaaaaattactttaaatgcttagtttattcaaagagcgatccaataatataaaaggaacatgtgttcaacacaataaaattttaaatggctctaaatcaagcacatcaagagtatacaagtcttaaaggctttttaatacatactcttttcccatctatgtaacccaacttgcacatttcagctgcatgtggtgaatatgcatcatatatttactttaagaggtaagattttacttgcaaaatacatgtgcaaattaggatccatcagttgatggaagagatggactctagaatattatttcttgtggttattactcctttacaaagcactttcgtctcacttgatcctcataaggaaactaaggctcagaatgagtagagctgggttcagaatctagctcttctaactccaagccatctcctctttccactgcaggaaactgcctcttttgtcagtgaaataatagaaagattgtgttagttaagtgataactgtcatttgtttgaaaatgttcgagactgaacaaatagcatttaaactgctggcatatagatgagatattgtacttttgtgcaatgtttattacctttgattaaattgtaatgtgaagcttttactaggtgaatagttcattatgtagtggaggcttcgtggttgtccattgaattgtcacagcaaaatctataagtttcttcaattctacaagatagatccatatacctttgatcacttggagactctttttttgctggtttctagataactcaggtaaatcagacctttacagagtacagggctaggtgaaagaattactgaaaaatcaccttgaaaatccgaagggctgatataccctttatgttcctgactgatgcgcagaacctgggggaaatctacagcaatatacaggttgcaatgctgataacacaacagcaatcctctcctctacgtggacttactgttgtttttttaattattattggaatgggattttagaaaatagaagttacctttgtgtgtgttttagggaaggtagagaagaatctgctctttctctgaatactgttttgaccccaggcaggaccttggaaaggccaaaacattaacagtagtacttctgttcactgaagagttatgttacatgaagataaaatggttttgtcgtgtttattaatgtattttgtgttgatataaataaacatggtaatgaaaccaatgaaaaaaaaaaaaaaaaaaaaaaaa

SEQ ID NO: 146 - DNA, 126259 bp, Homo sapiens
gaaaggagaaaggagccaaggagggagggaggttcccttaaagactctttcggaagtcacatacaatcttcttgttgatgttccattggctaaacttgatcacatcactacactaagctacaaaggaggctgagaaatatgatctgtgttctaggcaccatgtgtccagatgaaaattgaggctcttatttcaaagaaaaagttcagtccatggccaggcgtggtggctcatacctgtaatcccagcactttgggaggccgaggctagtggatcacctgaggtcaggagttcgagaccagcctgggtaacatggaaaaaccccgtctctactaaaaatacaaaaattagccgggtgtggtggcatgtgcctgtagtcccagctgctcaggaggctgaggcaggaaaattgcttgaatttgggaggcacaggttgcagtgagctgagatcacgccactgcactccagcctgggtgacagagcagaactctgtctcaaaaaaaaaagtatcagaaaaagcgcagtctggatattgggaaatgaccatcagtctatgcatgctcaggagttccatgtctagcagtgtgtcctataggtttgcttaacccatgtgacatttgacacgtttacaaggttattcactgcagcattgtgacagcaaaagactggaaacaacctaagtgtcctgtaataggggactggttaaacaaattatgggacatttatacaatggagaatgatggccacaaacacacatgaggaaactctcaatgcagtgatatgaaatggtatttaagatgtttcactttggaaaacagtttggcagtttcttatagagttaaacatacatctctcctatgacccagcaagttcacctctaggtttttgctcaaaataaaaatatatatgtatatatagctccacaaggacttctatgcaaatgttcaacagagtttaacatgtgatagacaacaattggaagtgacccaagatcgaacagccaatgaatggataaactggtgagtcaaatattacactggagtttaaatgagtgatccaatgtctgcaaccacatggatgaatctcaaaacatgctgaatgaaaacaagctggatacaaaaaatagcatgttgtaatgatgccgtttatatgaaattctagaagaggcaaaacagaccaatctatgatgacagaaagcagagcagtggctgcctctggggtggagggatggactgggaaggagcataaaagaatttcttgggatgctggaaatgttctgtatcatgattggggtgttgattacacaggtgcatttcactgcatgtaaattataccttgatatttttaaaaagcagggtgcagaacaatgtttaaattatggaatccggtatgtttaaaaagcaaggaaatttgcttgtatctgcattgactgtctagaagagacttgtaatagtgattgtcggtgggagaggaactgggtagctgggggctggggaaaagggacactttgggccataccctgttatacctgttgaatcttaaaccagttgaatgtactacctaattaaaaactaaaactgaaaagatcagttagatgcacacgtgacatcaccacattcatgttttaaatctcctaatggctcttcccggcaatctggacgaagttcagactctgagctgtcctggccttatgtggccccactcaggcagcatcctctccaaccacttttctgttccctgcagagacagctcagtgcctggctccctctggttggcctaagtgcatatgtgccattccctgagtgctcagctcctcggtgaattctccccagccccctgcctgagttggtccctcgggtctcactggacctgctgcactttgccttcccccttcctcatctatcagatcaacacgtgtttcccagagctctctgtgagctggaccccagagtcctggagatgtgtgggagccacttttatgggggaacctgcttccttgtttctgcttcagacagcaggcttctcctgccctgagactcccagcagcgtctcctcttcccaggcccagatctggcctggggtagaaactttgataaaatgtgctgtctttaagttaaatatggctccataaagaatgcattccatgacaagaaccaacagagccctggtttcttagaagatacagagaaaacacactgttgtgggagaattgtgtctgccaaaaagatacatcccagctctaaccctgggacctgtgattgtgaccttatttggaaacagggtttaggcagatgtagtcaggtcagggtgaggtaatactggattagagtgggctactccaatgactggtgcccttaaagagggaaacagacagaggagaacaccacgtgaccacagaggcgaagatgggagtgatgcatccacaagccaaagaaggccaaggaggcttgcagtcataaaagctggggagaagcgaggaagtgtcctcccttagggctttcagagagagcatggccttgccagcaccttgatttcagacttttagcctccagcactgtgagaatacatttcagttgtcttaacctacctggtttgtggttatttgttctttttttaaattttttatttatttatttatttttgagacagagtctcactctgtcacccaggctggagtgcaatggtgtgatcttggctcagtgtgacttccaccttctgagttcaagtgattctcctgcctcaggctctggagtagctgggattacaggcacctgccaccacacctggctaatttttgtattttcaatagagacgtggttccactgggttggccaggctggttttgaactcctggtctcaactgatccgcctgtcttggcctcccaaagtgctgagatcacaggcatgagctaccgcacctggcctgtggttgttaactgtagtcccaggaaatgaatacacacacaaaaccagttaatacctaagacaattccagctagtggcaagtgctttggaaaaacaaaacaaaacaaaacaaaacaaaacaggtgagaagggcgtgggatagagagggactgggaacggtgccacattagccagggtggtcagggaagccctcttggaggaggaggcatttcagtggagaggagaagcccagcatgtgaggaccaggcagaggtgctggtgagggggcacttggtgggcgtgaaagctactggatgcagctctgacgatggaggatacctgactgggattttggaggaagtctccaggaatgaaccgggaaggggctatcctctctttgcctctgcaggtctcagaacctgctgcatggctgctgcaggctgtccctcggcctaggccggctggcagccgatgaaggaggccagcctcgcagctgacatgctgctctctaattgtgattaactaccaagtcctctcctgctccggcctgaggccgctggtgtgacagctgcagagtgaatcaatgaggccaggaaggggttaatgggcagcccctccatctgagcccttcagacaataaggggaggtggggaggcctctggtgggggtgtgtggcatcagctggggtgagtgaatggaggggacagaggccttgtccctggggacagggtgtgagtgctctgtggggagaggggtcagacccccctcccattattttcatccacctccatcgtcctctcccctcccccacccagccagagcatcccagacaactgccctcttggctccaaagtgtgcagcatcttcagccttacggaattctgaagcagaaattctaaaagccaaagaactgcagaatcgtgacatgtcaccgctgtgggagagtccgtctagtcctgtcattctgaaactttcttttgcagtggaacccacaactcccaccccagctcatttccccccaaaataatagtgcattgataacattgagaacagaccctggtaccagccggcctcattcatccttcattcagccccggttctaccacgtacaactagggtaacttgggggtataatgcatagtttataggtgtgtgtgtgtgtgtgtgtgtgtgtgtcttccctagagacagagtcttgctatattgcccaggctggtcttgaactcctgggcacatgcagttctccagccttggccttctgagtggctggctcacaccaccgtattcagtagttccgtaggttttgacaagtttgtaagttatgtaaccaccaccacaattaatatatagaacatttccatcgctgaaaaatgttgcctcatgccccttgtagtcaatacccttccctgtgttacctgatatggtagcatgaataaaggtcatctagagttagtgactctaggccgggcagggtggctcatacctataatcccagcattttgggacgccaaggtgggtggatcacttgaggccaggagtttgagaccagcctagccaacatgacaaaaacccatctctactaaaaatacaaaaatgagccaggtgtggtgatgcacgcctataatcccagctactccggaggctgaggcaggagaattgcttgaacccaggagctggaagttgcagtgatccgagatcacatgactgcactccagcctgggcaacagcaaggctccgtctcaaaaaaataaaaaaaataaaaaaattagtgattctaatccttgaactgtgtaaatgttaccttatttggataaaggatctttgcagatgtaattaagaggcagaggttggagtgatgtggcccaaagcaaagaacaccaggaggctcccagaaccagaaggggcaaggaatggattctgctctagagcctccagaggtagagtggctctgccaacaccttgatttcaaatgcctggcttcagaactgaaagagaatacacttctgttgttttaagcctctcagtgtgtggtacttttttacagtagtctttacaaacaaatatacctagcaaccaccatgccttgttttctatctgtataagttttgcctttgcaaggatgttacatagacagaatcctgcagtatgaagcttttgtgagtttggcttctttcactcagcataacacagttgagatgcatccatgctgttgcatgcatcagaagtctgttccttttggatgctgagtagtatttcactgctggatacaccacagcttatccattcaccagttgaaaggcatttgggtcactcctaattgggagcattataaataatgctgctatgaacatgtgtgtatagatctctgtgtggacatacactgtcatttctccagagtagataccctggagtagaattactgggtcatattgtaagtgtatttataattttatcagaaattattacccgggcatggtggcatgcacctatagtgccagctacttgggaggctgaggcaggagaatcccttgaacccagtaggtggaggttgtagtgagccgagatcatgccactgcactccagcctgggcaacagagtaagactctgtctaaaaaaacccaaaaaaccaaagaacaaaactacaaagaatctgatgtggctcatgcctgtaatcccagcactttgggaggccgaggttggaggattgctggagctcaggagtctgagaccagcctgggcaacatggcaaaacccgatctccactaaaagtacaaaaattagttgggcgtgatggtgagtgcctgtagtcccaggtacttgggaggctggggtaggaggatcacttgagggtgggaggcggaggttgcagtgaggtgagattgtgccaatgcactctagcctgggtgacaaagtgagaccctgcctaaaaaaaaccccaaaaaacagaaagaaactgacaaactgttttccagtgtagctataccattttgcattctctccagcacttagtattgtcaggtttttaaaaatttagatattttaggccaggcgctgtggcttatgcctgtaatcccagcactttgggaggcagaggtgggcggatcacttgaggtcaggagttcgagacgagcttgaccaacagggagaaccagatacttgggaggttgaggcaggagaattgcttgaacctgggaggcagaggttgcagtgagctgagatcacaccattgcactccagccctccagcctgggcatcaagagtgaaactctgtctcaaaaaaaaaaaaaaattagatattttaataggtatgtaacaatcatagggttattgtgagaatgaaatgaacatatctgagaatactgcctagcacatggctcctggcttggaagggtaagctcctcttattgcaatcactatggggttatgtcctgtccaggacaaaaccagaggtgaaaactcaaaaaaaaactcaggtgggccaggaggaggctgtggggaccagtgagctcatgtcccatcttgaaggtcaaggtcccgggaagcagctcctgagatggaaatctgcatgtgggtggttttccaggtagtgctcttaggatcttggaggagccagggaagcaggctcgggcagttgcaatagaggccttgaccagtcccatcaggagctgggccagcccttaggacatgtcacagcctgagacagggaggtcatgcctctgtactctgcaagatcagactttggagtggttgcccacaggagagatgttattaatatcttgggtgaagcagcccttttaagctggtgccttgatccgggtgatggctttgaggtggaaaacaagcctgagtggtttcagctttcaacttttcaagagaagctatgtatctagattttgatgttaactctccaaacttttttaaaatgctggaaattctagacttttcaaacctgctgtgaggggctcacatgccaggcacaagggctggagggggcctgaggctgcctgtcgatgccccttgatataaaaccaggctgggtgcagtgccttatgcctgtaatcccagcacttcgggaggccgaggtgggtggatcacttgaggtcaggagttcgagaccagcatggccaaagtggtaaaaccccgtctctactaaaaaatacaaaataataataataataataataataataataataattagctgggtgtggtggctcacccctgtaatcccagctactcgggaggctgaagcaggagaattgcttgaacccgggaggcggaggttgcagtgagccgagatcgcgccattgcactccagcctgggcaacaagagcaaaactctgtctcaaaaacaaaacaaaacaaaaacaaaaacaaaaaaggaaaaccaaacaaaaaaacccccaaaacctgctgtgtcatctgacatcacgctagtgtctggttgccgcactggagaggacaccccatggggcaggaatctttgggttttgatctccaccacatccccagcatgtagggcagggtccaggcctggatgcagcacgagagaaggaacgcagggcccgaatgagtaatttgcctcagtgtgcaggtcatttaattgcaaagagaggaaaaacgacaaccaaaaacaaccaaatgaaaaaatgagcaaaggatttgaatagacatttctccaaagatgtacaagtggccaataaacagaggaaaagatgctcagcgtcagtaatcattagggagatgcaaatcagaattgcaagcacgagataccgcttcacacctattaggatgcctattaaaaaacaaaaacaaaaaacaaaacaaaacaaaaaaatcaggcagagtgctgtgactcacacctgtaatcccagcactttgagaggctgaggtgggcggatcacctgaggcagggagttcgagactagcctgaccaacatggagaaatcccgtctctactaaaagtacaaaattagccgggcgtggtggcgcctgcctgtaatcccagctactcgggaggctgaggcaggagaatcgcttgaacccaggaggtggaggttgcagtgagccgagaccacgccattgcactccagcctgagcaacaagagcgaaactccgtctcaaaaaaaaaaaaaaaaaaaaaaaaatcgcagatctgactgtgtgaccttgggcaagttgcttgacctctcagtgcctccatttcctcctctgtaacgtgagagtaaaaatactactcatacctacctcgtagggctgtcatgaggactgaataagtgcataggtacagacatgcttaggacagtatcagcacatgcaggaattacatgggagttggctgttaatattattacaggagtggatcaaatccatctctgccatggacttgctgtgtgacctagtgcaggtcactttgcctctcttggtccagttttctcacttgtaaaatgggaccatactgccactctccatagggcaagtgtgcggattcgaggagctcatatgtgaaaggcctccttcaggcgcaaggttggtccttggttatgcacgtatgtgagcctcttggcgtgccttcatatgtggggcataggcaagcactcaagtggcctggactcctatctcggctctcaatgtccccgcttcctggcctgggatcagcaggacctcagtggatccaccatccaggcacatccctttctttccctgcttttttcctgcttcttgggcggcaccaccacctactggcctaaagctacattgcagccaatgtgcacagcggggcggagggaagggaatatggccttgggcagctgctgtgcgcagaatatttacctctgtacacgcttagggtgctgaggcttagggagctcacacggagagagccagctgtgaagctggggttagaatccctgtctccctttcacctcactccaaacaccctcttagaatgggaactcagttcaggttctgccttgggccctagacgatccacccctcccttctgagcagggagccaggagctgaagtccagggtccttggaagtatgtcagggttgtccccccagggtcctgattacagaagaaagaacactggactcagagtccagaggttgggggtctagctttgccttccctatccccaactatcagcaaaacagcctttggaaaatcctcacccatttattctagcacttgtcatttcgaaatatatttactgtgggagagcatttaatgtgagtgttaggttctaacgcaaggagaaaattataaaaataaacaaaaacttttaaagaactcctaaaaatcctttaagtcactcataaagtataatatgggcagttttctaaatatagtcctttgcagcaataaatgcacggaccataaagaacagcagtatatggtggtgattgcatgcatttgcgaactgtaattttaggttctgttctctctcaggggtgtgtgggattccgagctgtggatccacacccccacatctctctcacagctgggatcatgtccaggcagaatcgcccacattgtgtacatcattctcccttctctctctctttctgagcgcacatagctgcatttccgaagttacataataaaaacagctaacatttattgagctttcattatgtattaggcctgctcgcagccctttgctcacgcattaattcattaattcagataatcctcctaagaatgttatgaggtaggtatattattatctcttctctttacagatgaggaaactgaggcactgaatggttaagtaactagcccaaggtcaaatagtgtaccacccagcccgaaggcgttcaccttgttcccgggtaggatcgcagaactggttaagctaggttaccgatccgggtggtgtcagctgatccctcagctgctgtagtgcaagatctgcaaaatatctcaagcactgatcttaggttttgcaatagtgacactgtccccaggaacaacttggggaggttcagacccttgctgtcagaggctgcacagcccctaaaccttgatttctaatcttgtagctaatttgttagtcttacaaaggcagactggtccccgggcaagaagtggatcttttcaggaaagggctattgtcataatttcctcagttacaatttttgcaaaggtggtttcaatagccagtgagtggtacagcctgaatttgaaggcaggaagtccgggacgagaacccacactcttgactggcatacttgccacctgaatggaggctccatagagccacgcgtgcatgcttgtgtacctgttgtcagcccgcaagctccgttaggcaggctagaacctgatccaggttaactttgcatccttagtgctggttctttccatccagggccccactcagggtatatgctcagtgactgttgtacaaatgcataaagctcagtttgcataaagctcacttcagcttctgtatctgtaagacaagaatcagagccaggcacagtggttcatgcctataatcacagaactttgggaggctgaggcgggcggatcacgaggtcaggagttccaggccagcctgtccaatatggtgaaaccccgtctgtagtaaaaatacaaaaattagccaggtgtggtggcacgcatctgtaatcccagatactcgggaggctgaggcagaagaatcacttgaacctgggaggcagagtttgcagtgagccgagatcatgccactgcactccagcctgggcgacagagcgagactccatctcaaaaaaaaaaaaaaaaaaagaatcgaaatcagctcttcagattgctggaggctccgacaagcccattggtgggaaaattctctttaaagacactgatgtgggctgggcacaatgactcatcctgtaatcccaacactttgggaggccaaggtggatggatcactagaggtcaggagtttgagaccagcctagccaacatggtgcaaccttgtctctactaaaaatacaaaaaattagccaggtgtggtgacatgaacccataatcccagctactcgggaggctgagatgggagaatcgcttgaacccaggaggcggaggttgcagtgagccaagattgcacatctgcactccagcctgggcgacagagcaagactccatctgaaaacaaacaaacaaacaaaacactgatatagtttggatttgtttcccctcccaaatctcaggtggggttgtaatccccagtgttggaaaaggggcctggtgggaggtgattggatcttgggggcaaacatcccccttgctgttcttgtgatagtgaatggattcttacgagatctgcttgtttaaaagtgtgtggcacctcctcctaccccgctccagccatgtagaacgtgcctgcctccccttcgccttctgccatgattgtaagtttcctgaggcctccccagtcatgcttcctgtacagcctgcagaaccgtgagccaattaaacttctttttttaaatgaattacccagtctcagttcattataccaatgtgagaacaaacgaatacagacactaaattctcctttgcccacctcctgcttggtcccttcttgaattttcaagctgctcaaccaagtggcctgcaccagcttgggagagctaatcgtgtgtatctgtacccaactctacattcagtaacatcatgtttgtagctcgaaatcagcaatggtgagtatttacactatggcaattggcaaatgcttcaaacaggagttttcccctctagagatgttaaacgtttgccaggaggaaatcaatcctctaatggccaccttcaaggaggcaacacagtggagtgatcatgcttgttggctctggagccagaacacctgggttcaaagtccagctctatcacttaccagctgtgtgaccttgttcagttacttaacctctctgagcctcattagtctcattcatgattacgtatttcattggggactcaatgccatcttccatataagtgctctctcaattaatgttatatattaatattatcaatcagcttaagaggtggggaaactttcttgttttccatcctaggaaagggagtgctgaggacaggacttgcagtgtcaaaaaggaacctcaaaaacggcaatgtgtaactgcaggtctgggccatttttgagggtctcttgagcattggcagaccagatctttatgccaacacaggttgtgcgtgtgggggttagaggaggagaggccttctcagttctttgcaggaaaggctactgttagctctagagcccagaacagatttagggggagagatgatctaaccaaactttccctctgccctcggcttgccagtcttctcgctagtgaacactcccagtgtgaggtagagggttccctgttccacctccttcctccctctgtagaggaggtatgcattggggcaggtgtgtgtaaggccctcctggggtacccctccagggaatcttcccatcttctccagtactgccccatctgacatcctgcctgaagccacaggtttcccttgcaatcactaaagaagcaggagggaaccagcagaactccctgcccatgtgcacaggaggtgatccagaaacttcaaggggaaaaatcctgctctccaccccagcaggcattgatttttggctgcgaagattacagtctctctctctctctctctctctctctctctctctctctctctcacacacacacacacacacacacacacacactcctgtgtgccaggaggttcctagaaggtcctcactcctcgcactcaggtgctccagggctagcccactcctgggaggtgcccacaactgaccacgatgcccacaagactgtgggaagggttgccccatgtgccttcgtgcccctcccactggatcccaacgaaggctcttttcacaacaggaatcagagcatgtcactcccaacctgcctaaaccctccaatggctcccaccacttttgatcaagacctaaatcctttctgagtccaccccatccttacagggtctaaccttgcttccatccctgtcttcaccccttattcctccctctgggctcctcttcaggcccttgaggtgccaagctcactcctgccctgggcctttgctgctgctgtccccttggcctggagcactcttccctgtcctttttgcccatgtgaggctgagaggcagacggaatcatggttgctagtgtagagaggccacactactggagtttgtatttcagttctgtcaccttgaactgggtgacctcacccatctctgcctccctttcctccctctatacagtgggaaagataatagcacctacatcttagggtgttgtgagactgattgagataatctgtatggtttttggcagtttctgaaatgcactgtaaactgtctggttctcctcccatcggaaggtgagaatctgactgctccccttgactctgggtgagagggtagggcaacagcaatgctccatgatttcagaggctgggtcataaaaacggtctgcaggggattcacttccagaacagtggagtgaggaacactgcagactgctttctggtgaaaacaactgatgatgatttctaaaaaacaatcatttgaagtctctggaaattgtcctaagagcatacagcaagtgaagaaacacttattcaagaaaatctactaaatctaggtaagaacagtgagtttgtagaacttgagacacaatccactctctttctcccctccattccattttactgttatggaaactcaactgtgagcagccagggccaagaagatgggagtcatttccccccaagctcctagtcgatggggtacagcatctccccaggaagggaaggctgccagcatttgtcatcctcccaacagctatatcttacagaggctaaactccaggtaggtgtggctgggagactgggatcttccttcctctacccagtccccactcatagggtggtggccacgccaagtgcagcaggctaaaaatattgaagccccagttgcttttgtcttagcttacttgttaaagcagaggttccatgcctggagatgcaagctgagaagaccagagactaagaatactgccccaactcagccctgctcataaagcaagaaggttactctgggagaagtgaactgttgtccctgcctccagctccagagcagtgtcacagatgctttgcccaagagagaggcaggtcataacaacacagatctttaaagttgtccataaaggaactgactttctttagaacagagtatgcagaaatttaagcctaagagtgccctcagaagcagtggcgattttggtagtgatcagggacccaaagttgctatactatatcatcttaaatgttcattttccagcaaagaatttcaagacttgcaaagaaataaacacatgtgacccatacacagggaaagaccagtcaacagaaactacctgtgagagtgctcagaggtcagacttgcacggacttcaaagcaaccactgtaaatatgttcaaagaaataatggaagccatgcttaaagaataagggaaggtaggctgggtgcagtggctcatgcctgtaatccccgcactttgggaggccaagaggggtggatcacctgaggtcaggaatttgagaccagcctggccaacatggtgaaaccccatctctactaaaaatacaaaaattagctgggcatggtggcaggtgcctgtagtcccagctactcgggaggctgaggcatgagaatcacttgaacccaggaggcggaggttgcagtgagctgagattgtgccactgcccttcagcctgggtgacagagagagactccatctcaaaaagaaaaacaaaaacgaaaatcaagaataagggaagcggtgatgactgtgtctcatgaacagagaatgtaaacaagaagatactattttaaaaaacttaatggaaattctggagttgaaaagtgcaaaagaaaaattcactagaggggctcaacagtagacttgagccagcagaaggaagattcagtgaatctgaagacagatcaatagagatttcgcagtctgaagaacagagagaaaaatatgaagaaaaatgaacaaagccttggagaaatgtgggacacagctaggtgcaccaacatatgcacaataacatatataacagaaggagagcaaagagagaaaggaacagaaaaaaatgtgcaaaaataatcactgaagcctttgcaaatttgatgagaaacatgaattatgcattgaagaagcttaatgaactccgagtagaacaaatgcaaagtggtcaacaaccagatacataaaaggaaaatgttgaaacccaaagataaaaagaaaatcttgaaagcaacaagagaaacacagctcatcacatataagggaacaccaaataagaccgacagcagatttctcatgtgaaacgatggaggccctaaggcagtgggacaacatattcaaaatgcataaacaaaaactaccaagcaagaatcttacatccagcaaaattatctttcaaaagtgatgatgaaagagatatttccagataaacataaactgagaatttgttgccaggaaacttaccttacaataaatactaaaggaagttcttcagacagtaatttgaatccacacacacaaaagccaaagtgctctgggaaaggcaagtagatcgttatgaaaggcagtaagaatgcatatttattcaccttctcttaacagatttttaaaaataatttgtatataattgtattgtggggccaagacatatagaaatgtaatatattttgataataatagcacacaggaggtgagtgggagcagagctgtattggattaagaaagtgagaccagatgggaactggaatccacaggaacaaatgaagagaaccagaaattataagtaagaaagttaataaaacaaagtcttttaatatatacttgctctcctttcttctctcagcttcttcaaaagacataaaactatataaagtaataattataacaaagtactgttggttttgtaacatatgtagatgtaatacatataaaaagaatagtgcaaagaggaagaagagagaatagtgctatataggagtcaccgggcacggtggctcacaactttaatcccagcactttgggaggccgaggcaggccagtcacttggggccaggagttcaagaccagcctggccatgtatctctacatataatagattgaaaccatgtatctctacgtataatacaaaaattagccaggtgtggtgtcatgtgctggtaatcctagctactggggaggctgaggagaattgcttaaacccaggaggtggaggttgcagtgaaccaagatcacgccaccacactccagcctgggcaatagcacaaaaatctgccaaaaaaaaaaagatagaaatatataggagtaatatttctatatatcactggaattaagttactgtaaatctgaagtcaattctgataagttaaaacctatatagtaagcctaaactggtcattaagacaaacaaacagaacagtgaaaaagctattaaagaaatttaaggctgggcacggtggctcacacctgtaatctcaacactttgggaggctgaggtaggtggatcacctgaggtcaggagttcgagaccagcctggccaacatggtgaaaccccctccctactgaaaatacaaaaaattaggtgggtgtggtggcaggcacctataatcccagctacttgggaggctgaggcaggagaattgtttgaacctgggaggtggaggttgtagtgagccgagatcatgccattgcactccagcctgggtgacagaatgagattctgtctcaaaaacaaaaacaaaaacaaaacaaacaaaaaatccaaaaaacagaaatttaaataatacactagaaaatattcgtttagtgtaaaagatgtcaaggaagaaaagaggaacaaaaaagacatgagacatatagaaaataaaaagtcaaatgacagacataaatccaacttctctcaatgatagcattaaatgtgattggatcaagtcaaaagggagagatttcctgactaaataaaaagccaagatcaactatatactgtgtgcagaagatacactcaagattcaaaggttaaaagtaggttgggcgttaaaggctgaacaaaatatatcacgcaaacagcaaccataagaaaacttgatttgctatattaatatcaggaaaaagactttaaaatgaaatatgttacaaaagataaagaggaacattttataatggtaaaaggatcaatcgatccattgggaagacataaaaattatagacagatatgcccctaacaacaaagccccaacatgtgtgaagcaaaaacagaaagaattgaaggggcaaatagacaattcaaaaataatatttggagacttcaaaaccccacttttaataatgaatagaacaactaaacagaagactaaagaaggcaatagaggctgggcgtggtggctcatgcctgtaatcccagcactttgggaggcccaggcgggcagatcacctgaggtcaggagttcgagaccagcctgaccaacatggagaaaccccgtctctactgaaaatacaaaattagccaggtgtggtggcgcatgcctgtaatcccagctactcaggaggctgaggcaggagaatcacttgaacctgggaggcagaggtttccgtgagcccagatcacaccactgcagtccagcctgggcaacaagtgcaaaactccgtctcaaaaaaaaaaaaaaaaaaaagaaaaaaaaaagaaggcaatagaagacttgaacaacactaaaccaacaagacctaaaagacatctatagaacatttcacacaacaacaagataatacacattcttctcaagagtacgtgaaaaattatttaggacagactatatgttagaccacaaaacaaacatcaatgatttttttatcttttatttttttttttaatatggagtcttgctctgttgcccaggctgaagtgcagtggcatgatctcagctcactgcaacttcagcctcccgggttcaagcaattctcgtgcctcagcttccagagtagctgggattacaggcacccaccactatacccagctaatttttatatttttgtagagacagggtttcaccatgttcgctaggctggtcttgaactcctgacctcaagttatctgcctaagtcggcctcccagagtgctgggattacaggtgtgagcaaccgtacctggacaataaattttaaaagattgaaatcatacaaagtaccttctctgactaaaatggaatgaagctagaaatcaatagaagaaaaccaagataattcacgaatatgtgaaaattaaaaacacactcaaacaactaatgtgtcaaaatagaaatcacaagggaaattggaaaacaccatgagggaatgagaataaaaatataacataccaaaacttacgtgattcagtgaaagcagaaaaatttatagctgtaaagacctgcactaaaaagggagaaaggggccaggcgtggtagctcactcctgtaatcccagcattttgcgaggctgaggcaggcggatcacttgaggtcaggagtttgagaccagcctggccaacatggtgaaaccccatctctactaaaatataaaaattagctgggtatggtggcacatgcctgtaatcccagctacttaggaggctgaggcgggagaatcgcttgaacgcaggaggcagaggttgcagtgagccgagagcgtgccactgcactctaacctgggtgacagagtaacactccgtctcaaaaaaataaaaaataaataaaaaaatttttttaaaaaggagaaaagtctcaaaacaaccacctaactctacaccttaaagaactacagaaagaatacaaaaattagccgggcatggtgatgggcacctgtaatcccagctactctggaggctgaggcagagaatggcatgaacctgggaggcagagcttgcagtgagctgagatcgtgccactgcattccagcctgggcaacagagcgagactccgtctcaaaaaaataaataaataaataaaaaataaaaagaactagagaaagaagcacagactaaacccaaagctagcagaagaaagaaaataattaagattggagtggaagtaaacaaaatagagtatagaaaaacagtggtaaaaaaatcactgaagctgggcatggtgccacatgcctataatcccagcactttggaaggcagaggcaggtggatcacttgaggccagcagttcaagaccagcttggctaacatggtgaaaccccatctctactaaaaacacaaaaattagctgagcctggtggtggacacctgtaatcccagctatgcgggaggctgaggcaggagaatcacttgaacctgggaggcagaagttgcagtgaactgagatcatgccactgcactgcagcctgggcaacagagcaagaccctgtctcaaaaaaataaaaaataaaaaaataataaatcaaagaaacaaaaaattgatcaatcaaattgacaaacctttagctaaactggctaagaaaagaagattcaaattactaaaatcagaaatggaagttcggacagtactactgaacttacagaaataaaaataattataagaaaatactatgaacaattgtgtaccagcaaattggagaacctagatgaaacggacaaattctggccaggcgtggtggctcacgcctgtattcccagcactttgggaggcaaaggcaggcagatcacaaggtcaggagattgagaccatcctggctaacatggtgaaaccccgtctgtactaaaaatacaaaaaattagcctggcatggatggcacgtgcctgtagtcccagctactcaggaggctgagacaggagaattgcttgaacctgagagatggaggttgcagtgagccgagattgtgccactggactccagcctgggtgacagagcaagattctgtcaaaaaaaaaaaaaaagaaagaaaggaaagaaagaaagggacaagggacagattcctagatacacatgatataccaaaactgagtcatgaagaatggaaatctttatagacctgtaatgaagcagtgatcaaaagccatccaaaaaagaaaaacctttgacaagtccctggtgaattctaccagacatttaaagaagaactaacatcaatctttctcaaactcttccaaaaaatttaagaggagggtcggggggctgggagatccaacatgacctcatccacatgactggcaattggtgctgattgtcagcaggaatgtctgtgttctcctccttgcggtcactcttgctctgttaggtcagacatcatcccttacatagaggcccaagggtccaacggtccaagtccaagactgaagctgcaaggtctcttgaggcagaggctctgaaaaccacatgatgtcacttctgtcacacgctattggtcaaagcaagtcacatgcctcactcagcttcaagtcagtggagaaacagactccaccttggatgggaagaatagcagagtcacattgcaaaggggtgtggataagggttgggaggaatgtgtagccattaatttacaccagataatgtgagtgtttgcactttacaaggtccacaggtccactgatacagtttggctctgtgtccctacccacatctcaccttgaattgtaataatacccacgtgtcatgggagggaccccatgggaggtaattgaattatggggcgggtttttcttgtgctgttctcgtgataatgaagacatctcaagagatctgatgtttttatcggggggagttcccttgcctgccaccatggaagatgtcccttgactcttccttcatcttcagccatgattgtgaggcctctccagccatgtggaacagtgagtccactaaacttgtttcctttataaattacccagtctcaggtatgtctttattttattttattttattttattttattttattttattttattttatttttgagacagagtcttgctctgtcacccaggctgaagtgcaagggcaccatctcggctcactgcaacctccgcctcccacgttcaagagattcccctgcctcagcctcctgagtagctgggactacagtgcacgcctccacacccggctaatttttgtattttagtagagacagggtttcactatgttggccaggctagtgtcgaacttctgatctcatgatccacctgcctcggcctcccaaagtgctgggattacaggcatgagccaccatgcccggcctcaggtatgtctttattagagcgagagaatagactaatacatccaccaaccctaggaagtcagtggaagggtatttccgtatttcatatggaagtcatttccatatgaaaatttagccagaggatttcatgctggttgtctgaaagccaggagcttctaaaaaactttcagggtagctgtctaagcatgacctcatgtcatcctgttgtgagtactaaattagttaattcaggggaggcactcagaaaagtgaagaaagggaaatctttcttatataaatcttagaaatctcatagaaatcttaggaaagtgcctggcgtgcagtaaacacgtgatacatttcagttgttattatcttcacaataatttttttgggtcaggcttgttattttccctgttttacagattaaggggcagagactcagagatgcgcagtaagtcgcctgagggttacgcagcaaataagcagggaagccagatgagaacctacatgacagagtcacccatgtgtgagactccaaagcctcattcaggtgcacagagaggcggttgtgaggacgttcactgctgcgttgccttcagtagcttaacatcagaaacagcgcagatgtccaccaacaggggccacccagtaaaccccagcatgcccagccaaggagtgctttgtgctggttacaagaaatgaggtcacgctatacataggacatgggatcatctccaagacattctgttcagtaaaaagaacatctgaaaaaaaagttccataacccacagaaaatactgccaaatattccaaaaaatctaagtccaagtgtgtgtgtatgtgacctctggaggctgatctgaagcaaatgtaggtgaattaaacaataggatctatttataggactcttcttttcctacttttctttatttttgttggattttgaaacatgttcaaagaaaaattcagagtacaataaagtaccagtcgggcatggtggctcacgcctgtaatcccagcactttgggaggctgaggtgggtggaccacctgaggtcaggagttcgagatcagcctggccaatatggtgaaaccctgtctctgctaaaaatacaaaaattaggtgggtgtggtggcaggcacctgtaatcccagctactcgggaggctgaggcaggagaattgcttgaacccaggaggcaaaggttgcagtgagctgattgtgccactgcactccagcctgggcgacaagagtgagactgtgtctcaataaataaatgaaagaaagaaagaagaaagaaagaaagaaagaagaaagaaagaaaagaaagaaagaaagaaagaaagaaagaaagaaagaaagaaagaaagaaaaagaaaaagaaccaagaagaaaaaataatcaccggagattcctcccctcccctagagctaactaggctaacattttggtatatatctttccagtccggatcctgtgtgactgagtgtgtatatgcatatgtattattttcaactgttggctttctccttgtggtccaagacagctgctccagatttagccattacatctgtttcctgccagcaagaaagggaaaatgggaagtagagggccttttaagtatacaacctagaatttacacacattattctttatcacatctcatttctctaaatgtagtcgcatggccatcctggccagaaggaagcctgggaaatgtggtctttcctctgggctgccttgtgcccagtgaaaagtcaggggttctatgactatgaaagaaacaggagaatggatattgtggcaactagcagtgctattcacctttattctctcaatggtaatatttttccccatcaagaggggaaaatttgtgtcttacattctaaccactgaactccgagagaagacactggcctgtgccattctcttgcgatggagtttcgctctgtcgcccaggctggagtgcagtggggtgatctcagctcactgcaacctccacctcctggattcaagcaattctcaggcctcagcctcccgagtagctggaattacaggcacctgccagcacacccctttttagaccacatagggtagcttccgactgttgccatggcatttgtgaattgtcatgtgctggtgggagtgtctcttagcatgctaatatattataattagcatatatattataatgagcagtgaggaggaccagaggttgctttcatcaccatcttggttttggcgggatctggccagcttctttactgcatcctgtttgttttatcaataaggtctttgtgacatgtaccttgtgaaaccagtcctgcctaagggagcggggctggcggttgttcagagtgaacaattcaaagtcaggtcctccctcttggagctcagagacttgaagagcaaggaccactgtcaggacacaaccccatttgcaaggccggggacacacatacagacccacaggccattgtagagaaagtgttaaaagatggaagtcaagccacggccactggaagtggtgtgccctgagaggcagagggttctccctaagccagggaaggacaaggcagggcaagacagaaactgggcctggggccaggattcctgagctggggctagatttgcccaaatctagggcagggctgactgggtcaagcacagcagggagccagggtgggtcgatccccctgccacaggcttcactcttctggctctggtttccaggcagttctaaaagcctcccagtggcccagtgcagtggctaacgcctgtattcccaacgctttgagaggccttaggcgagcagatcacttaaggccaggagttcgagaccagcctgaccaacatgtcaaaaccccgtctctactaaaaatacaaaaattagccaagcgtggtggcagtgcctgtaatcccagctacttgggaggctgaggcaggagaacccaggaggtggaggttgcagtgagctgagattgtgccactgcactccagcctgggtgatagagcaagactgcatctcaaataaaataaaataaaaaaatcaaatcaaataaaatgtctcccagaatacaccaccccagcaaaatggcaggagggagtgtcacctggggacctccactttggaggtttgagtgggcagctttaagctggaacagtcactcttgctgtgggttctcagggcggagactgagcccccaccctgcctcctcaaatgcatttcctctcagctcccacctgccagcccaggagagagggagggccattctgtccttttcctgcagagtccctttgttcagttggtgaccaacatcctgaaaaacattctcaggagatcaaaaagaagaacattttggtctatgtggtaggttggcccagtgcaccacgcccagtgcaggtccctcttgaaaccacctttgggaaattatgactgagacaccacctttgcaaaattatgactgagacaatgagagatctttttttttttcctttgagacagagtttcgctcttgttgcccaggctggagtgcaatggtgtgttctcggctcactgcaacctccacctcctgggtttaagcgattctcctgcctcagcctcccgagtagctgggattacaggcacgcgccaccatgcctggctaatttttgtatttttagtagagacaggtttctccgtgttggtcaggctggcctcgaactcccaacctcacacctgaggttgcctcagcctcccaaagtgctgggattacaggcgtgagccaccacgcctggcccacagtaagaggtcgaacttaacctactctatcttgcttctaacctccaagctgtccttgttcattcctgggcataagctgaactaaccttgggagaaacttagtttatactttaaacagccctttcccaaagcagacctccttcttgcctggggactaagctgcctttgtaggactaacattagccacaaaattagaaattttggtttaggagtcatgcagctggaggctacaagatcctgaccctccctaaactactcctgacatcagggcttgagatatttttcagaccctgcacttgatggatcagctggcatcacccacgtcaataaactggctcatctgatcttgtggcccccacccaggaattgattcagctcaggaagacagcttggactccctgtgatttcaaccctgaccaatcagcactcctggtgcactggcttctccccacccaccaagttatccttaaaaactcttctccccaaatgctcggagagacagatttgagtcataaaactccagtctcccacgcagctggctctgtgtgaattactctttctctattgcatttctcctgtcttgatgaatcggctcttgatgaataggcagcctgcaaggtgaaccccttgggcggttccactctttgcccagggtgatgttatttctctccaggatggctgcagcggcttctgagcctgcttgcatctggtgtggtccctttcaatgtcacgcaggccaaagcagccctccatctctccatgatcttggcttccaaggtactctgtctctctctctgggtcgccatactggcttccatcaggccctggaatgcatcctgctggttctatcccttggccttcaaaagtgcggtttcctcctggaaggcaccttctgccttacctcacacttccttccctcctacctgccttgagataccagcttgcaggggcattcttgggaaagccgaccccttggactgagtctggagttttgatctctctctctcttttttttttttttggagatggagtttcactcttgatacccaagctggaattcaatggcgtggtctcggcttaccacaacctctgcctcccaggttcaagtgattctcctgcctcagcctcccaagtagctgggattacaggcatgtaccaccatgcctggctaattttgtatttttagtaaagatggagtttctccatgttgatcaggctggtctcgaactcccaacctcaggtgatctacctgccttggcctcccaaagtgctgggattacaggcatgagccaccgtgcctggccttttttttttttttttttttgagatggcatctcactttgtcacccaggctggagtgcagtggcaccatcatggctcactgcagcattgaactcctgggctccagcaatcctcccacctcagcctcttgagtagctgggatcacaggcatgtgccaccatgcctagctaatttttgtatttttttttgtagagacagggtctcattatgttgcccaggctggtctcaaactcctgggctcaagcaatcctcctgcctcaacctcccaaaatactgggattacacgtgtaaaccaccacatccagccctgatctcattcttcagagaatttacctagctggtcacttggtgtctgtaggagcatcgcctctcaggcctgcctcaaaactgcatttcagttgggagtggggcggggggagggagagtgtagtttggggacatcaagcgtctgtggtggatctcctcccaaagtgagactgctttttaatgatatttattgagcacttactgtttgccactgcggtgctaagcactttgcacatactagctcagtgcatccttacagcaatcctgggagggaggtgcttttctcatccgcatgtgctgacaaggctgagaagagctgggtcttgcacggtaccttaagggctaaagacctgcaaggatggtgcatgaaagcaaaaccagagaggcgccttttccaaatgccaatgcgccctccacccagtccttcacaaaccacatcagcatggatagcaccacactccacaggcttttctgcatctcctttgtgtgtgtgcacatgtgtaattaattctggggcaacttcctacatcagtacagagaaactccttgatcattatccactccaacatccttcctgggagggactgactggaaacccaaatgcccttgtaagggcaaatacaaaaactaaaataattctccctggtgcagaaaaaggaaagaaacctcccgtttcctgttcttaaacactctagagcaaacactttagaaaacttctcaattatttctctgttcctttaagatgtgtctttttaaaagccaggtgagcctcctgccagttttacaagccagggatgttttcccaaggacctaggagccatctctttggaaggtaaacatcaagattgcacccttctcatccagtctccatgggcagataggagcctaacttcagtgcttggctccaagttgcaaaacaatccatcgtctatcataaagatgtgagtttatattttctctggataaagacaattagctaacacagatggccactccaattaccaggtgaattcgggatgaaataagttgcaaattgtgttgtgcagtcatctgactcgagaactatttttttttttttgagacagagtctcgctctgttgtccagtctggagtacagtggtacgatctcagctcgctgcaacctctgcctctcaggttcaaacaattctcctgcctcagcttcccgagctgggattacaggcgtgcactaccacacctggctaatttttgtatttttagtagagatggggttttgccatgttggccaagctggtctcgaacttctgactttaagtgatctgcccaccttggcctcccaaagagttgggattacaagcatgagccaccaccccggccctagttattatttgaggacatgtatgcaataggttatacctgcttggttatataggaggacgaaatgtatttctctttgtaatctcttttgtggattgcctgtgatgcccactgcagtctggtttaacgcttatttaataataaaactgttttctcttctacttttgtggaaaggttttctggattagatctttaattttgtctccagcatcttcaaatgtctttctacagagggttggttaaataaatgtggcatctccacaaaagagaatactgcacagtcatggcaaaaaaacaaggagcctgttttcgttgttgaatgaaaagtgcaaggtgcacaacagtttactactttttctgtaaaaaaagaggtctgagaaggctgtatttgccatttgtataatctctggaagggtaaacagcgactgataaaagtgctcgtgtgtgtgtgtgtgtgtgtgtgtgtgtgtgtgttaagagaaactgggcagatgagggagaggaaagggatgaaaacctttctctgtacaccttatattttctgattttttgaaacacgtgactgtattacctattcacagtaagttaacagggatgggaagcatggtggtggcaagcaaacgaaacctctaaaaagaagtcccaggggccgggcgcagtggctaactcttatgatcttagcgctttgagaggccaaggtgggcagattgcctgaactcaggagttcgagaccagcctgggcaacatggtgagacctcgtctctactgaaaatacaaaaaatatgccaggtgtggtagtgcgcacctgtagtcccagctactccggagactgagaggcaggagagtcacttaaacctgggaggcagaggttgcagtgagccgggatcacaccactgcactccagcctgagcaacaggcaggactctgcttccaaaaaaaaaaaattagccaggtgtggtggtgggcacctgtaatcctagctactcaggaggctgaggcaggagaatcacttgaacctgggaggcagaggttgcagtgacctgagattgcgccacggcactccagcctgggtgacagagcaagactccatctcaaaacaaaaaaagccccagaaccagacatccttaagcacttgattctgttcatttctgagctcagccttgagcttagaaccaagtgaaaactaattacacattttcggagttcacattaaacttcttctttttaaaattattatttttgagacagaatcttgctctgtcacccaggctggagggcagtggcacgatctcagctcactgcagcctccacctctggggttcaagcaattctcagtctcctgagtagctgggactacaagcatgtgccaccatgaccagcaattttttgtatttttagtagagatgggtttttgccatgttggccaggctgatctcaaactcctggcctcaagtgatctgcccgccttggcctcccaaagtgctgggattacaggtgtgagccactgtgccatgcctgaacttctcctttgaaggaagatctgagtgtaaaagcagggaatgcctttatttaaaaaaatgaaaaacagaaactaaaacaaaataacaatcacctctgttgcctccatttgagagaatacttccaggggctctgcatgtctggtccccaacctggtcggggagttcactttcagaggctcagggatgggccttccccagccccaccagcaaatcatctctcccggcttccaggagggtacttactctccaactagtgggctttatgggccaggaaggatgacaggaaggggtgtgtggggtactacgtccctccacactgagaatccgaaagccaagatgcccaagattctatcgttatctgcttgtcttgtagaagcccctctgtgagactgaggggcaaaggagagagggcaggggcgtgtctcaacccttctggccacttctaggttgtgcagactgccactcttgttactacgatggactgtcagatcagcaggtggcccaggagggcttgcttgatgcgggctgctttttccttttgcctccgtgccatgcctgtgaggtagttggtacttactggaatccccactgcatgcatgaagaaacaggcacagagaagccaaatgactttcccaaggtcacacagcctgaagggacagccggctgtcccagctgtttcccttctaacacccttgggcctgcctccagctagatgctgcaaatcagtcctctcttgagagtcaaagcaaaggagatctgagctggtcgtcacaggtagtgtgacacagagttggggatagagccgcaccttgcatttccaggtgccatcttccccacagtccccagtgggcacttgcgttcatgattcaattactcaggctctgtctctctgttcctgccccttgctctgtgacctggcctctctggaccccagttccgtccgtgagcgatgggggcggggtcggcggcctgcctaggctggacagtgcagattgcagaagtccgcggacgagaagagccgcagcacgttgaccagagggaacatgagcagcgctccgagcagcgagcccagctgcaccgccgccccgcaccacaagagggcgctgcggctgaggtcgcgcaggaccacgcccagcatcaccttgacgtaactgaggcagccgctgaaaagcacccacgaggccacctgcggggccgggagggaagaggtgcagagtcacggggcttgcggggcgagcgccggagcaaagaactctcacagggctcaggggaacccacggaatactctctaggtgcgaggagcgccttctgggagtgagcctgcggggccgacgggtcccatgagttggccgcccgggggcgaaggagaatccagtggcttttctgggttcacgtgcccatgatcagggcaagggcccttgagagaaggcccctgctgaggtacacatggtgggaagaggcctaccagtcacctcgattccctaagcctccactcccaaatgaggaaggggcgcttcccccacctggggcttcccgggagggtcccacagaccccgctcgctggaaagggccgcgcccaagctctcccaggccttggctaggggtgaggggtacgcagcgggagcagccccaccggccggatactcacaatgaggacttccccaccccagtggccctgcaagagggggcaggggctcatcaccgccatggccatgttgtagcccccaaagcaggtcccaagcacggagaggacccccaggaacagcagagacctagaggaaagtaggggaggtgagtggaggtgagaagcctgacctctgacccccccgccccactgggcggcatgtggatggccagtgtctccatagttagtttagacccatgtggaaaattccaggttgcctggctcaagtgggtcagggaggctcctgagcaggcagggctggcctgagtcatccccagcattaacggcagggcctggcaccccggcaagaaaaacataatggactctggcaccggatggtcctggttcaaatcccagttctactgtttaagctgagactcgcctctgagcctccaaatcggagttttgcaaggctgcatgacctccaggagcagagcatgcaggcctggcgccgctgtgggcccacctggtgtttacctgctggcatttcctcctgcaacacaccctcagcctcagccaggaagctgagttgaagtgaagatggctggatcgggcattggcacagtagggtttgctgtgcctcctcaggagacccctccccttctggcctcagctacctgcctctgcaatgtggagtgtgctgatctccaggggtcctggcagctggcttgttgctgctaggagcatctctctacaggtggccttccatgcaaacctacatctgggaccactgtccttcctcacaggtccttgtccctggggtcccaatctctagaaccccaagactggtccacgccctgggtaagaacagacagaggtctgcctatacccttaaagactctttctgctccaagattcttggattccatgactcagattctgtaattctaacatttggggtttcttggatttgcaggtctgagcctttggtcctgcttccctcaaatcctccatcctctttccagtttctaggtcccaaggtagaaaatccagcttcctggcaagctttctgtcaagctcttctgtcctcactgtccttcttctgggctgggagagtgggtgtaagcaggccagtgaggacaggcaggccagcgtggatacgaggctgtaggacccacctcaaatgtcaagatcccaaggtggtagttctcctacaggggtctgaagcccctgcctcagaaccgtctggtttccttactaaaaattgaaatcccaggtcccagtctaggctggttcaatctgcattttatcaacttgcccagccattcttctagaactgtggctctaagggaaccagcaggaggttagaggcaggaaggcagggccgaaatcctgggaattagaccaggtcaagctctttctccaagcctcagggtttccccttataaacgggaacctcagtggctatctgctcctcctcatggactgatgacaatgatggtcaacgcttaggctggacctgccacgtgccaggcaccgctccaagagctttatagaatcagctcatatcatgcttccagcagtcctaggaggtggaatgttacactcccattttccgataaatatccctgaggcacagagaactgaagtgacttgtcttacacacagctgacaggtggcagagctgggatttggaccagggtgctccccaaacatgttcttaaccactacatgtacagcccagtaggtgcgtttggaattctgggttctgaaatgaagtgttcccccactaggattccctaggaccagatgagggcacacctgttaggcaggaacatggagaccaacgaggcaagagggttggccacaatgctgagggtggcagccaggtggtaggcaactggcccataggacaggcaggagtaggtctgcacagagggcagcatgccgttggtgagcgcgttgacgaaggccaccagggtatagatgaaggccaggtgcgccgggcagcagggggctgctttctcctctagatacccctggccctggctgctgtccaccgtgcctgcagggcccaagtcattctcttcccgcggccggatggagtggagggtgacctggtcattgaggaggtcttccacggaagcctcccagcacctgggttgacgctggaggacaaagaacgccacgaggcagcaggccatcatgatggataggaggaggaagaagaccaggggtgagaagtgggcgggaaggtagcggctctccaggtgggacaagggtgcttccattccggggagggcggacaccaaagctctgggaactccctgcaaaggacaagacagatccctggtcaggggaggggatcaggctgcagaacaacaatcatgacagtgataacagaatacagatcacctgttattattaatggataatgaataaataaacataactaacaaggtggcaataatgactgctcatactgactgcccactgagcacgggcactgtgcatggataagcccctatgcctcctaacagggctgcacagtgggcaccatcatcccccattttagagggaactgaggtatcagaatgcttcgtcccttacctgagggtcacagggagaatgtggcaaagccagactccacctggtgctttctgacttggaagctacaccttttatcaccccacagcagtggcaaccacaaacatgttcagaggaggagctagctggagactgagcagtggagccgcccacctaagaggagagcccccacctaaggggagaatcccccacctaaggggagagcccccacctaaggggagaatcccccacctaaggggagagcccccacctaaggaagaacactgctccacccatcgtctaggaaataagggccttcaggacatgccatcccaaaatatgactgtaggaggccagaatatgccaccccaaaattgacctattggcatattttttatttctagctggttattttgaaaaattgcaggctaaggagtagctctgaaaagttgccattttgtaagataaatttacatctaaaggaaatttttattagtaaagctatcttatctgtaccaagaaaaggtatctgtaccacgaaggggtatctgaaccaggaagagaaaggtgatggcctttatcacccgaggaacttttatctgcataacagtgcaatgtttattcaccataagtttcctcccttcactctcccataatttgtctccaccatcctgcagtagcctcaagcccctattcccttttgtagctcaggatgctatagaagctgaaatcatctggcccttttttgagtctcatattttttggggactcccatgcgtatgtatgtaagtaattaaaatgagtttcctgctgttgatctgccttatgtcagtttaactcataggccgaccaaagaacctagaaggatggaggtgagcagtttttccctcccctacatttgtgataaagccaagtgctgagatggctccgggtgatgctgggtacctgtgcgatgtcagtctccctcgtgggtacagggcttggtacgctgtctgatatctcagtgacattgacgcaggtagtgagaccggagccctgggcaagagccaccagggcgggcaagaggccgctgagtccttcacccacaaagaaggtggtgaggtagtaggtgggcagccggctcatgaacggcaggaaggtcactgaagaggtgcagtccaccagggccaggaagaaggtgaggaccaagaaggcgatgctgtggtggccgtccagcacccaggaggtcatattccagaggaaggcaaagatgatgcaggtgacggttcccacgcccagcagggtgaagatgatgggcacttcggaaaggcagctgggccggaagtgatggagcagggtgaccaggaggggcccgatgttggccagctggatgaccaccgtgaggtaggagggcaggtaccagccctcgggcagctccatcaccagcaggggcagctctacccagagcccattgatggtcacccaggagcccattccgaagacgcagaccagcaggtgcatcaggaaggccatggcggtatctgccctgggccagaggctttctcagatcagcctgcagcggggctggcagagaaggacaccaggtgagtaattccagcttcaccacctagcaagatgctgggacctggggcccagagttttctcttattactccccttcctgtgaacaagctggcttttttttttttcctttgagacatagtttcactcttttagtccaggctggagtgcaatgggatgatctcggctcagtgaccctctgcctcctgggctcaagtgattctcctgcctcagtttcccaaatagctgggattacaggtgcatgccaccatgccagctaattttgtatttttagtggaaacagggtttccccacgttggtcaggctggtctcgaactcctggcctcaggtgatccgcctgcctcggcctcccaaagtgctgggattacagtgtgagccaccacgcctggcccaagctgtctttttattagcagaaaacaagagaagcctttcctaaccgtgattcatgaaagaaaagttcaatccgacacacaaaagcaaacaaagcagcttctgcaaaagataccaacagcaaggtcaaaagttaaatgaaaacacggggaaaacatttgccacataaatcacagacaaagggctcatcttccttgtcaggcctctgagcccaagcctgcgcgtgtacatccagatggcctgaagtaactgaagaatcacaaaagaagtgaaaatggccggttcctgccttaactgatgatattaccttgtgaaattccttctcctggctcagaagctcccctactgagcaccttgtgacccccacccctgcccgccagggaacaaccccctttgactgtaattttccactacctacccaaatcctataaaactgccccacccctatctcccttcgctgactctcttttcggactcagcccgcctgcacccaggtgaaataaacagccttgttgctcacacaaagcctgtttgatggtctcttcacatggacgcgcgtgacattcctaatatataaagagtttttaaaaatcaagaacaaagagaccccatatagaagagggccaaggatatgaacaattcagagaaaaaggtacaaataagctttaaacacatgaaaatattatcaccttcattcacaataggaaaactactccaggtgccatttctcaccatgagattgtcccaaagcctgacaaaatgactcatgttcaaggttattatagattgcgatcttgttggtaatagcaagttatgggaaattttctcctgggtggctaccaacagagagggggctaattaaagggacctgctggaataccacatacctgtttaaaggaataagaaataaggaaagcagatcttggtgactgataaggaaaggtctccaggctataataataatcttgaaacaaaatcaaggcaggtaaatggaaccaggaaaaagtgtactgccttttggtcatagaagaggaggaaaaacatgttttctttgcttgtacttgcacaaagcaacccttgaaggacacacagggactgcagggatgttggtgatgcctctgtatatcttttttttttttcttgtgacagagtcttactctgtcaccaggctggagtgaagtggcacaatctcagctcactgcaacctctacctcccgggttcaagtgattctcctgcctcagcctcccaagtagctgggactacaggcgcccaccactacgcccagctaattttttgtatttttattagagatggggtttctccgtgttagccaggatggtctcaatctcctgatcttgtgatccaccctcctcagcctcccaaagtgctgggattacaggcatgagccaccgctcctggccctgcctctgtatatcttttaataagagttttgatttgtgaaccatgtaaacatattacctgatgcaaatatatggttacctgaaataagatttcaatctggctttttttcctcctgaaattatatcactctctacgtggcctttggagaccacttcctctagccctccagagccattctgccatctgtttacccctttgtcagctaccagtggcagcccacctgtgctgttactaacaactttcttctatctatccttagtctgagcagtaatatgggagatgccaggagtgaggctctggagccagctgtttgagtttgaccctggctctgctgcttacaatctgggtgaccctgggcaagtggctttgcctctctctgcctcatctcctcatctgtaagtaggggatagtgatagtatgaactccgtggtttgttgtgagatataaggatgctggtgagtttatgctgtttccaacagtcccagcatagggtaagcacctctaagggttactgatcattatcgtgaaatggcaggtttggtgacatcgttatttttgtctaattcacatgagaattaatacatgactatgaaaatttaaaaaaggaaaagattcccctactaggtatcaagtgaactcaccagtggtatatgcacctttttgtagagacacgctaactgggccaatcttcacgttttgtagatgggagacgaggtccgaaggggcagaggggctctcctgggatctggactggatcctctgcagcaagcggcctgtccgggactcctcagttcacgctgcagtctttaactccatacttcttccttctagtacaaagcaggagtgtccgttgtggccacgcctcacccaggaaactcctgaatcctggcagctcctccccacggttcccacacacggaattccctcacagggctgggacttccttcctcataccttcactgagcgaacccaatgctcagtggcctttctggtcacctccttttcctctctgggaggagccactcctggggtgtaacgcagtcagatcccctagcagtcccgctctgccccctcccttctgggggcctcagactccattccctcccttaggaagctgacttgactaatagcacaggtgaggcccactccaggcgtgccaagaggacccaaggagggaggggaagctcccagacagcagtggcacacctttgcctgtgctgtcctcccagcctggagcaccagccccctctgctgtccacatccaagctttctacaagactccgtcctccaggagacctctggctgcctcaccttctcaggcgtcctcaccagggcccatgaccccttcatttcaggttgttcttgtgtgggtgcatgcaggcacataccttgagactgaagctttttgagggcaggggctgcttgggaatctgacattttgaaggtggaagggcctttctcaatgacttagcttaggatttgtaaattgttaactcactggccactgccagacagcagatatattactttggtttgcccagtgtgtttaacaatttgttactgtaatcagcagtggaggggatggcaagcaaccttcagcatttctggcttctcaggaatattttggaagaagtggccccccactttggcctctttctctgttctagactcgggccatcttggagctctcccctgcggtaacatctggaaccagttgcctgggttcaaatcccagcttcaacccttacaagctgagcaagtgacctaacctcctgtgcttcagagtcttctcttgcaaaacagctataggctgtcagtaccaacatcagaactgttgctaggaacatgcactaaagtgctaaaactgtgcctgccacatagtgagggctcaatgaaccatcattataagattactatttcagcaaacgtatcagttgcattcaaaaacatgtagttattggccaggcgcggtggctcacgtctgtaatcctagcactttgggaggatgaggcgggcggatcccttgaggtcatgagtccgagactggcctggccaacatggcaaaaccccgtctctactaaaaatacaaaaattagcccagcatggtggcgcacacctgtaatcccagctactcaggaggctgaggccggagaacggctccaacctgggaggtggaggttgcagtgagccgagatcatgccactgcactccagcctgggcaacagagcgagactccatcttaaaaaagaaaaaataaaaaaaaggcgcagtttttgttagacaaatggccactcaactaaaggactacatttcccagccttctttgtagctgcacatggccatgtcatcaagcacaggccaatgaattcaaatgcgactttgagtagtctccttagcccgtttcctgtttagaaaaaaaagtgcagctcgttgccagcactcatttaattttatgtaaacgtgctatttgaggctgaagcaaatctgattctgactgctgttttttttttttttcttttgagacagagtcttactgtgtagcccaggctggactacagtggcttgatctcggctcacagcaacctccgcctcccgagttcaagcagttctcgtgcctcagtctccttagtagctgggattacaggcgtgcaccacaatgtccggctaattttttatatttcttagtagagacggggtttctccatgttgccaggctggtctcgaactcctgggttcaagtgatccccacgcctcagcctcccagagtgctgggattgcaggcgtgagccaccaagcccagccctaaatctgactgattttcaatgtgaaaataacatgtaaaaactgtttttgaagttatttctaaccagaactaacatcagactcatctatttcagaaaaactggattcatcaaacgaatctttggtcaacaactgttcaagaacaatgttaacatcacacataggaatgctaggatttgctattttcagcgatcgagaattactttgttttgtaaatggaaataccacgactaaaaccagaatgctacaaatagagtgatgtcttttgtttccaaagtcaatatactagagcaaggcaaaaataataataaaagcgaggtattttgtggcaaagttatcttggggtaaacactgcagtcacaagtgggtattccttctggcaaacagggaaagagttaacaataagggagtgtgcccttctgctcttcctccatttggctgtctggaatcagatgtgatggccagaactccagcaacgattttgtgctatgaggcatgtggtgggggttagatgcatactaggctcctttgggattttgtggcagagagcacccataccagccctgttttgcctgtgttgaactgttttgtttgtttgtttaatgttgttgttaaattgtaaaagaaacttctatgttgtttaagtcactcttattttatgtacaacaaaagtactcagaggctgggtgcagtggctcactcgtataattccagcactttgggaggctgatgttggcagatcacttgaggtcaggagttcaagaccagcctccaactggtcaacatggtaaaaccctgtctttaccaaaaacacaaaaaattagccaggtatggtggtgggcacctgtaattctagctactcgggaggctgaagcaggagaattgcttgaactcgggatgtggaggttgtagtgagccaagagcacgccagtgcactctagcctcggcgacaaagcaagactcttgtctcaaaaaactaaaagaaacaaacagacaaaaactactccatactaagtgcacagagatacacattccaggatatatattgaaagattatagtaaccaaaaactaatgaatacatttatctcctttaccacctactttctgactctgaaacttaggtcctgtcccaaccaggatttgatcaaaaatcaaaatttaacaaaagtagttgtttagacccttgggggcaaatgtcttgcagagatatgaaaaaaaaaaaaaaaaggagaagagagaaagagggaggaacagaggaacacagaaccctccatatagcatttggtaccaaaagtataaattgagaccaagagtcatttcatatatcaaaactctaattcataaaggagtcaaaattgtagtgactatctgtattctgaatatttcctgaaatagcctcagacattccaggagaaatggacagaagcacagtccagcagtacaggcctgactcacccttccaggtcaagacagcagacgaaggtgcaaaataaacaaggatatagcaaaagcaataaatgatatacctagtaaagagggctaagtcagtagttaaggggagtaggcgaatttgcagatgatggtgacctttgccatatgaaaagctattaaactaatgagagtgtccagttaaacatttacaaacatcagtagctttcccacagagggctggatggggagatgagggcagacagggcagaagtagcctcactttcttgtatgttcgacaactcctaagctctgaacgcctaaatccctgctccccacaaagacgaattctctggttttgacccaggtgctaccacggctgtgtcacttgagggatgggatttggctccgggggtctgtttccttgtctggaaaccaggcacagtgggggtgtgtccccacgtgacccatctgccctatggccctggcccactcccaaattatctccttcctcaaaagtgaggtgtgcttttggacctcggggacacagtgaggaacagtcattaatgtcaatgaaggggatgtcttaggcagagggaactacatgtgcaaaaaggccccagagaaaaggagagactcagaatggctggtgttcggaatgtgttgggatacttttaaaagatgcatatctgtattttctgttttttttttttttgttgttgttgtttgtttgtttattttacagtgaccttgcagttcttatttattcattttaaccagtatttcttgggcaccaactgtgtgctcaaccacaatccctgctctcaggaagttggaggaagcattcacgaagcagaataaaaaacagaaacatagagcaggtcagatggtggcaaggactccggaggaaagcaaagctcctgaatggggaatgtgccgctgtcaaggagaggacatgaagggagtgtgggagtgagctgtctgcagaaagcacggtccaggggagaaaacagcaagtgaaaaggccctggggtgcggccacacctgctctgtcccagaagtggattttgctgttcaaaggacagctaggaggccagtgtggccgcagcagcgggagccaggttggaggggaggagacagggcaggtcccctgtggccctgtggtgacagcttgggtgttttctctagagcaaaaagctccgtgagtgggcagaagagaccagctctaatctagtttttaacaggatcgtgctggctgttgtgaggagaaacatgaggcgccagggaggaagcaggagtaaaccttcggagggttaggaagctgtagcaaaagagctaacaatcaccatgacaacagtgacaaccatagctgccactcctcagctatttattgtgccagaccctgtgctaagctctttgaacacattacctgtcaaatcttgttccacaatcctgaggctggcattatgattatctccattttacagatgaggaaactgaggtttaaaagggaaataaatttgcctagggtcatacagctgggagctgagctttacatccaggcatgcttgactgtggacccagccctgagaaaggcctcagggtgaaggggttctgaaggggccatgggggtcaagctgagcaggatctctttctgctcacagatggcctcccaagacttgggccagagaaagagagaaatggggtacaggctcaggagaagctgagagaggctctgagacatatctgcttcccaaggatccaggaccccttatgtgatcaccagagaccagaaacctaaggcttcgcatgagacagttaagatgccccataatgcgtgggcgacagatagagaagctagaaggatcagttccaggcaaaggtttctcttttgcattcttgcatcaaaagctgtgagcccccagcccaagaaagtgaagagaattgggagtggggttctgaccagggccagtgcaccgtcattgtgtgggctgggccatctcctccagggagctcaggcagcttccatcccacccaatgtcccccgcccccctccacattctcctgccctctgttttcctccatcaaagtattactgacaccagctcagttacgggagtttatctgtgtctatctgttgagcgctggtctctcccattggagtgtaatctccatgtgagcgggggcttgtcctctcccccagtgcccaggtgaccatctggcttgccacgggctgggccacctgagctcctggcaccatggctgggttctcgctctgcagggataatctgccagctggtaggcacctagccctgtgggccagactggaggaaacccgcctcagctatgagggttgtgttggccagggtgacccctggggcagtgccaggtggcagcctgacactggatacatctcactcctgggcaagggtctgagccaattctttcctgggttccaggctcctggagaacttagtgaggcctgtaggcgtctacttagggcctggcctcaccctcatgagagtgggtaggaatggactgactttgagcccatgaagaagggaggctgagaggtcaaaccacaaaacccacagggagagatgggggagatgaaggggagtgagagagaagagactgagacaaagagacagaaagaaccgaaagctagaagcagaaatggggagaaaggacaacagaggcacagagacagggaaaaatgagaagctgcggctgagagggaggcagggaggtgccaggaggcaggaggcagctggggcgctgggagcctggcctcagccaccctcactgttcacagccacatgtagcagaaggccatctctacctcttgttgctgggacctcagagttcccctgaaactcatcccaactcaatgtccctattgcacaggtggggaaaccaaggcccagagaggagatagtgcttccccgaaccctgccccacccctgatctcaggctgtggcagacattcaggcctgtgctcaccggctgtgcaacctcaggtcagctgctcaccctctctaggccttggtttctccatctgtgaaagggtctgggaatgcccagcctttctgggctcagcagaccaggaaaaagggaatgagataacaggcgctcagcctggccagtagaagcggacagtgagttctcttcccccttctcctccctcccaaggccaggaagggcttcaggcctcccatggggctgaccttggtggagcagcctcccccaggccagttcccctcccctccacgtccatcccaactcccagcctccttcccaggctcctgcggcttcagcctggtcaagttgttccgagatagcatggagatggccctgggtaaagtcagtgggggcccagtcttttttttttttttttttttttttaagacaggatgtcgctctgtcacccaggctgaagtgctgtggcatgatctgagctcactgcagcctcaaccttcctggctcatgcgattctcccacctcagcctctgagtagctgggactattaacccatgccaccacgtccgacctgggtaatttttgtattttttgtatagatggagtttcgccacgttgcccaggctggtcttgaactccctgagctcaagcgattcacctgcctcagtctccagaagtgctgggattacaggcgtgagccatgacacccagcatgggcccagccttttggtctggaggcaccaggggtctggaattcacctggatggctcagcctgtcccgactccaacatgccagctgaggaggaaacctttcttccctcctgtccctttgatctttcacctggatggctcagcctgtcctgactccacatgccagctgaggaggaaacctttcttccctcctatctctttggactctcccgacatggcagcctgaaactaggggaaaggccacgggacacctgctggctccagataagtgcccctgccatatcctggtcagtgtcccatgctcctagctagcaggcagccttggtagctgcagctgcaccctcacaggcctgagccgccccgctttgcccacttacctgctggtccagttccccagccgctctgcatgggaggggccagaggcagctcgttttgtataaagctgtccccgcccagagctcggggaaaggcaggcggagggtgggtgtggctcccggcaagaccaggcgcctactatgtgtctctgatctgccctacagcccagctaggaggaggatccagatggtagaactgtataataaagggcttgctttattgaggctctctgccacccagatttcatgagggttgatccccagttgacaaaagctatgtgcaaacagttggttctggcatcaccctgagatctccataattcctttcacacaggaagagagttccctggagcaaaaacagttcaaatactggtgcttcagtaagtcatgtggaaagcggggataataatagtgccctcttcataggacagaaatcctaactgccagtgtgcactgagctgactcagtgtcaggcatgttcttggggcttgagagaaattaatgcatttaatcttcatggccttttggagagatgctattactatccctattttccagatgaagaaacaggcccagagaagtcgagagccttgtgtaggtcacacaccttgtatatggcagaactggtctctgatgcacactgagctaccctgacaaatactgtaaccacctgaggggttctttctgcccactgcataaagaaagaccatgaggctggccatgccacaggggaaatgagtttgttcccaaatcatcttcaaagcttgtaggtgaggggtttttcaaaggcagtataggggaagagttgggggtggccaggtaacaggtgcttgctgctgattggttggggtggagatgaaatcatagggggttgaagctgtgctcctacaggctgaatcgcttttggggggggggccacaggagcagggttggcggtcctggtggagacatcaggtttaggtggagccatgggtgtcaaatctgcaaaaaacctggaaagatggcggggcgtggtgggtcatgcctgtaatcccagcactttgggaggccgaggcgggtggattacctgaggtcaggaattcaggaccagcctgaccaaaatggcgaaaccctgtctccactaaaaatacaaaaattagccgggcatgatggcggacacctgtaatcccagctactggagagactgaggcaggagaattgcttgagcccgggaggcggaggttgcagtgagccgagatcgcgccgttgcactccagcctggacaatagagcaagactctgtctcaataaaacaaaaacaaacaaacaaacaaacaaaaaacaaaaaaaaaacaccaactggaaagatatctcaaaaggccaacctgcaacagtggtgttatttgcaggagtaattggggaagttgcatatcttataacctccagaataatggctggcaatcatttatgtctacaccttaggaggacccaggctcctcttctttccccagcctgatggcctctcattaactttacaaaagtggttgctcacagtgctacggcctgtaagtgcagggccaggatgtgaatgcagactcaaattggtgcctccatggatgtaaaacatattgcacagattctgacacctagtaaatgctcagtgcatattgacttctacaaataattctggcctgcctgttgtgttattttccaagacattcatttacttaacaagcaatcaatcactctccaggctaatgcttggggcgagaggtgagcaggcactagggaaggggccagacccctcgcttagcaggcaggtgttcaggaagtgttgccactgttggggctcaggacatacacacccccaaaatatgactctgggaaaccagaatgtgccacccccaaatacacctctttgacatactttgagctggttattcagagaaactgcagacacaggagtagctctggaaagctattctttggtaaaagaaatttacatctatcaaggaaatctacattagtaaaggtgcctgtatcaggaaaaaggctgctccagaagaattaccctagagactttcttttttttttttttttttaagatacaatttcacttttttttgcccaggctggagtgcaatgctgcaatctcggctcactgcagcctccgcctcccgggttcaagtgattctcctgccacagcctcccaagtaactgggattataggcgcacgccaccatgcccagctaattttgtatttgtagtagagacaaggtttcaccatgttggccaggctggtcccgaactcctgacctcaggtgatcttcttgcctctgcctcccaaagtgctgggattacaggcttgagccactacactggccaccagacagacttttatctgcacaggaagacaaccattatttaccatacaataattcttcccctcaccctcccataactgtgtctccgccaatcccccaaagccctaagaccctattccttaaacttcaatcatctgacccttctttgagtctcatattttgtgggatttccacgcacagatatgtaattaaatatggtttctctcctgttactcagtttcatgtcaatttaattcatagcccagccaaagaaccatgaaaggtggagggaagccatgtttcccttctctatagtaccaaatactttggatctgttaaaaaaaaattgcaggactctaaatttatgatgccaagggagaagttaagccttgcagagtgtgagttatgtggcttgcaggatggccactttcttcttctttttttttttttttgagacggagtctcactctgtcgcccaggctggagtgcagcggccaggctggtctcgaactcctgacctcaggtgatctgcctgccttggtctcccaaagtgctgggattacaggcatgagccactgtgcctggccacaatttcatacttatctctgccaaatactataaggtgtcaaaatttggcatagagggtacaaaactataactcaatccaaacagaataatctttgcttgtataattttttaataatgaaacatcaatattggtttaataaaggcagctatatcttgaactatttagttaaataccctaacttctaatcctgtggccttaggaagtctagtctacagacgtgaaggaagtttctttagggaaaggacttatcatctttgatattaaagaaaagagaatttatataaaaataatcttatatggtaaattcttgttctaaagtaaatgaattggttgtttaaaaagaaggatgtttacaacgagtcagaaagttgaggcatgtcagagattgtgtaaattgtaaaaattttataaaagggaatttatgcaagaaatgttgtacagtttaaaagtgatgagggggccgggcacggtggctcacgcctgtaatcccagcactttgggaggccaacgcgggtggatcacctcaggtcaggagttggagaccagcctggccaacaagatgaaaccctgtctctactaaaaatacaaaaaattggctgggcatggtggtgggtgcctgtaatcccagctactcgggaggctgaggcagaatagcttgaacccagaggcagaggttgcagtaagctgagattgcaccactgcactccaggctgggcgacaagagtgacattccatctaaagaaaacaaaaacaagagcgactaggcctcctgaatgctttataaaatgccaccataactcttaactgtacaacttgcctgctttgtagctgggtaagacctagcacacatggagttaaatgctggaataagtcagaccttatctgcacttctgtctaggtcctaggctctacatctagtacataattacaatctcaaactgactaacaaaagtaaaagttgctaaaagttaacagtgtaacatgtattgttccatagaaagaatctaagataagactgtaaagctgaggctagccgtggaattgtaccattaaatacctatgagtttcctcttgaggttgcaagataacctagggttcccggcctctcagaaagggcattctttgcttaccacagatcagaagccctatacagggactgtgtacacaaaatataaggccagtttccaagggctttcttggcttcgtaaatcaagtttgattccttaaaggaaagcataccattccagtcaaggccttggtaaaaaaaccagtttttccaattgtgtcctgttacaaaagaaaacagattcttattacacttgtgcaaataactatatcgccataacttaagaatactcacagatagtttccaaattctggagaaaatcagggagagagaaacaagtatgctacaaattttgttcatgggagtatactaaattgttaaaagctgttaatagctcaaaagaaaaatttcgaggccggatgcagtggctcatgcctgtaatcccagcactttgggaggccgaggcgggcggatcgcctgaggtcgggagttagagaccagcctgaccaacatggagaaaccccatctctactaaaaatgcaaaattggctgggtgtggtggtggcacatgcctgtaatcccagctactcaggaggctgaggcaggagaatcgcttgaacccaggaggaggaggttgtggtgagccgagactgcaccattgcactctggcctgggcaacaagagcgaaactccgtctaaaaataaaataaaataaagaaaagtttctttgactttgaaaagcaaaacaaagtattagcaatattttaagcaaaatatcaaaaagatcactccagtctcctattagttcagttcgtgcagttaattcctgtcctgcttgatattaatgaacattttagctaagagtcctaaccatttttcctgtattctgatgtcacaatctccaaatttatcagaaacctgcattcaagaacacctgttagagctttatagctgagtataaaacccttctaaagaggatcaaaacaagacaacaattgtttatggatgaccaaaagttttagggtagccatagttaaagacacaattgacaaggaaatctgttacttctgtggcacacaataattttaacataacaattataattactactgataacacacactaagacatatcagaattataggagtctcccataactttggaacacataccaataacatatttatacaaatatggcccaaagaaagccaaacattattttatatttgacaatgcttcctgtatgacttcataccaaataagccaaattttacctttatattagtgtgttattaatgttaaactcaattttaatgttttgatcataaggtcagattttcatggacccttttttttttttgagacagagtctcgctctgtcgtgggcgacagagtgcagtggagcaatcttggctcactgcaacctccacctcctgggttcaagctattcttctgcctcagcctcctgagtagctgggactacaggtgcccaccaccatgcctggctaattttttgtgtttttagtagagatggggtttcaccgtgttagccaggatggtcttcatctcctgacctcgtgatccgcctgcctcggcctcccaaagtgctgggattacaggcgtgagccattgcggctggcctatagaccatttttaaccctttataatttttgtcaaagagcaggttagtgctttaagaaaaacccattgtgcttttattttaatactcaatttacagaaaaactggatgatacacctttaactttagccaagatgtttacacacagtatttcctttacaattaaccttccaaaagttgcttaaaccttcatttttattttattcaacttaaaacaattctttaaccttttaatctaggtaaaaatccacattctcatgcctccttataatctttttaccaaaagtatatgtaaactgttttttcaatagtcttaaatacatgttacactgttaacttttttttttaaggcctacgtaacaaataattattcttggctgggtgtggtggctcacgcctgtagtcccagcactttgggaggccgaggcaggtagatcacctgaggtcaggagtttgagacaagccttgccaacatggcaaaaccctgtctctacaaaaatacaaaaattagctgggcgtggtggtgggtgcttgcaatcccacctactcgggaggctgaggcaggagaatcacttgaacccgggaggcagaggttgcggtgagcttagattgcaccactgcactccagcctgggtgacaagagcgagactccatcttgggggggaaaaaatgggaaactggagagagaaaattacatttcagaaactataacacacctgttattaaattccagtgttgcctaatgttgttcaatttttattactttaaattaaattctaatttttctgactacgagtttccaaaataagctttgttttcttaaagccctatgaactgaaaactagacgtttcagcaggcactgcctctaaacgccccccagccatcacaggaggaaacctcttcactgctggagctgacaactaataactgagcgtgcctggaatcctttgcccccacatctaataagtccatggaacccagggtaattgagatggcatctcttacaagaatcaacttctgggtcaggtgcggtggctcacgcctgtaatcccaacactttgggaggccaaggtgagtggatcacttgaggtcaggagtctgagaccagcctggccaacatggtgaaaccccatctctaccaaaaatataaaaaagttagctgggcatggtggtgcatgcctgtaatcccagttattcgggaggctgaggcatgataatcacttgaacccaggaggtggaagttgtggtgagccgagatcgcgccattgcactccagactggcgacagagcgagactccatcttaaaaaacgaaacaaaacaaaaaaacaggaatcaacatctggatacattacactcgagtcaaagcctggaaagctgaggaagcaacccctgatagccaaaggaacatcctaaatatcagtgtaaagaaataggaaattttaagctcataaaaggtaagtaactgagtgagaactacttatcttactcagtctcacccctacctcaccaaatacttttagatgttcctacctctccttttaagacaaatattaaaactttttaatggaaattattcactacaccaccattgtgggaactgctttacacactctattatttgcagtgggactatgtactacagcaccctcaggatggaatatcagacagagaatctcaattatggtaccattttgcttaattattatcctcatagcaggaataacagttactaacagcaaataacacatgggcctttccagacatgtgcctctgcctgtcattgggtgaggaatgttgtttctatatcaaccaattaggcctagtaagaggtgctgttgaaaaacttaaggaaagggctataccaaaacaaccaaatagattcttggtttaggaacaaaatcatagcatgggtcatcccattcctgggacctttcctaataatatgcctaggactaatgttcttaccctgcctaattaacctttttcaaagatttttaactgacaggatcatggccatttcacagacaactacccaaaaacatccacagacagcgttactgctacagttaatccaagaccagaaaactctgtcccctcatcagcaggaagtagccagaaagaacaccctgcctttcatcctttttataactataaggtctggattgacagagcaggagcattgccatcttggacaagcactgccattctaaagttccccttgatcaaaaaccacctaaatccaaagggcatcagcctaatggctaaggtcagcatgaccataaaccacaaatgacatctctgaccagaaacattccaaccataagttaaagccctccccgaccagagacgtgccagccccaagataacctcccctccaggtggagagatgtcagccccaagataccgtcccttccaaccagagacattccaaccctcaatagacttctcccctacacaggaacattccaagcctgtgataagctctcttacccagaaaccagtaaatacccttagtatgtaagagagagcattcctgactgaaattggacagaggcccctctcaggtttattcttcaaaataaacctgtctttgactgttgagcctcttttcatgtttctttcctctttcttgaactcttacaacacctttgttaggcgcaaattttcagtgctgcaaaagaaatagcactcgaacataaatttaattttctcagcaaggcaattttacttctatagaagggtgtgacttgtggatggaacaatggtgagagcacacctgaacaagggaggggaaggggtttttattcctgatgcaggtagcccctactgctgtgtggttcccctgttgactaggattggaccacacagtctaagctaattccgattggctgttttaaagagagcaggggtacgagtcggagtagcggagtgagtagtttggcgggaaggacagttaggaacaggtgactaaaggtgactcaggtcagtgcaggtgaccaggggtgactcaagaaggagcaggtgatcaggggaatagatgtgaactactgattagaactggtggaaaaggttgtttactgaaactaggggcaaggaggcaaagagaatgagaaagttaaactttaaaatggagaacaaagaacaggggacctgaatatactcatacattggttccttggagaggatctcagaactcattgtacttaacaatttacaggctgaaacatttgaaaaggaatttgttatatcctacaatttccccctttcaattttcatagtacttcctcttcaaactttttaaacatgtcttggcttagctgctcgacttaatcctctaaaagaaaaagcttatctgaataaggtggaggtgagttaaggaagattttagtaagtgctgcttttataagtctttgcactagcccacagatgcatggtatgacataacacctaacaagaatgagtacagctattacggctgcaagagaagtaagaattgaggctgtgatttctttccatttactgaaccccctttctagccaccctgagaaagggttatcgactccagaattttagctagttcattggatagagtggtaagtctttataaggcccttgttatgttcccagtgtgggcagtgttatttgggataaaggtacaacactgagttttaatcataatacaaacaccactttttctgctaatatcatatctggtgccattctgttttcccaggccatctggctagtgggccccaattgttctgctatccctttgacagcatccctggtgtaattaataaactgctgctgattataatagatgtaatttatccagtctacatttttattaatcgtcacccatgaaaatattgacttaaatcctgcagctatttgatctcgggctttaaattcatctggtactcctagtggaactccagtaatgtttatataaacatgggggtcaaacgactcatgtaaggcacttcttttacaattttcttttttatcatgttgacggaatgctagagtgaaagggatggccaattggactagagcacgagtgctgctctaattgcttggcagagtatccagcaatagtgcccctcaatgccaccacacacctgctcagggatgaacaagggcagactgatgggtaagctcttgaaaaggcttggtttcaccgcaccctgttaagtctccaaggaatgctaacttttccccctgccgtgaaagggacaggtgaacttaacatcaggggctggaggctggatggccctccgggctgacccacagggctcttgacctcggggaagagcagtgaaagcgaacagcagtgaaagagttttgcctgactcattgccccggctgtggggttctggaagagagctaccatacagctcatgccctgtccatgagaggaccactcgaggggaaaggggacaatttgggtctctggcctgcctgtcgcacaagcagtcacttttgtttagcatgcgaacagaatatttaatccatttcagccaagcatttacatcctggtactctgtttcaattgctatagtttgttttaaatctataacttctacaacagctactttggttttatcattgggtatataacgaaagaagatctggttagtggagaacttaggagtgggagaagggggtgcaggagttgaggaggcaatgaagcacatttcaaaggatcctctggggtccttccctgagacttctgctcctataccatagaaacggtactctggggagcagaggtggtaatctgtactggattacattggttcatctgacaatggggtggtccatccttgctccttggtagtccataagccattagaccagctaaaagttctgttctaggagggcaagattcctagttcatactgggaccatcatcaatatcttcccagactaactgatcccagttaacagattttcagtctgaggagagccaggaaggacaaagatacttttctgaaggggagagttgcctctggtttggcagatctccacaggtcatcccaaggcaagcatcaaaagtaatagtttggggcgaacttgttacataaagaacgagaagactagcaatagaaggggaaaagaaagagatggaatgtaagaggatcaaacccgttttagctttagcttggttggagttggccctggaatagctgtccatgattctggagggggtggtgctcttttgacctaggtgtgatgagtccatcctctttctgctgtttgaactgtggtctcggtggttagaagcaacaggtagggtccttcccaagccagttcgagtttcccttccctccaacttttgacaaggacacagtccttaagctgatgttggtgtactggaaactgtaggggtggtacctgttctaaaagacctttagttctgagggaagagaaagtggaaaataaaccaagtatataatttctgagaaactcatcttttgttttgaacataggaatgtcagcagtggagtgtaaacagggcaacctacacaacatttcataaggggataagccaacatctctctgaggagcagttcagactctcaagagggcaatgggagagcatctatccatggcaaccgagtctctaagactaatttggttaggtggccttttttttttttttttttttttttttgagagggagtctcgctctgtcgcccaggctggagtgcaatggtgccatctgagctcactgcaacctccacctcccgggttcaagtgattcttctgcctcagcctccctagtagctgggactacaggcacgcgccaccatgcctggctaatttttgtatttttagtagagatggggtttcaccatattggccaggctggtctcgaactcctgacctcgtgatccacccgccttggcctcccaaagggctttttttttttttttttgacagggtctctctccgtagcccaggctggagcgcagtggcgcgatctcggctcactgcaagcaccgcctcccgggttcacgccattctcctgccaaagggcttttttaaaaaatagtttggttcattctttccactcttcttgatgaaggtaggtgccagggagtatgatattcccatgttatatccagtatctgggctaatttcttaatgacatgtacagtgaaatgagtcttattatctgaatcaatgttttctattaatctaaacttgagtataagattttcaactaatgccctgtctatgttattatcagttgtacttgaaaaggaaatagcttctatccaatgagtaaggtgatctactatactaataaatacttcagatgatcagttggaggcatctctgtgtagtcagtctggatactttggaatggccttaagcctggactccttcccccaaggggtaatgttttactaaacaactgtctgtaacctgtttggccagggtataaatcctatgcacccataaactctgatgaatgtgtcacacgaggcttggggcctccaatgggtcctttaatgcagttggaataagacttccctcataaggggtttggataacatttctctctggtctagcaatatccattttccttctgaattctctttagcacctatttttattagtttttaaaccaaagaaagccaaacaccattttatatttgataatgcttcctgtgtgattttataccagataagctaaatttcacctttatattagtgtgctattaatgttaaactcaattttaataaaatcttgtagacatatttattcaattttaatgtctgaccataaggtaaaattgttatagactctttctaacgcttcataatttttgttaaagagcaggttagtactttaagaaaaacctgttgtgcttttattttaatgtccagttcacagaaaaactggatgacacccctttaactttagccaatatgtttacacacagaaattcctttacaattaacatttcaaaacttgcttaaaccttcaaaacaattttttaaccttttaatgtaggtaaaaatccacattcttatgccttcttataatccttttaccaaaagtatattttactttccttacacgccttgaacataaactgtttcttcaatagttttacattcaggaggcctaattacttttaaattatacaacatttcttgcataaattcccttttataacattttccacgactttcacagaccatctttgacatgacttaaatttctgacttgtgaacattcctttctttaaacaaccagttaatttattttaggatgagaatttaccgtataagattctttttacataaattctccttttttcttaatgtcaaagatgataattgttttttcccaaagcaaacttccctcatgtctgtggactagactgcctaaggccacaagattagaagttaggataatacatgttacactgttaacttttagcaaattttacttctgttgaaaaccttgtaagtttggaattttaattaaaggaaggcttttttggtgtccggggacatggacaatagttatttttttggcaactgaaggttatttaatacttgggtgattaattcctcgtggaccgggtcttgacctttgctattaataagacctggttcagtccaaatttttccacatgcatgagccactccaaaggcacactgaaaattggtatagatggttccttcctggttctgtaagtactttaaggcttggctgagtgcaaacagctcacacgtttgagcagaccaattattaggcaattttcctaactctatctctacacctttaaccattgttccctatttctcattcaaacttggacataacggtatgtgaaaaagagcctcttgtgactgttacctctttacaatggaatgttaagcaacccctcagaaagtagggagtagcaaatcaaatctttgtaactacatttcagcctttgccggttgaaatgtcagagccccggcatcagaaagtggtcaactcaagggctgataagaagaatttaccaacaacagtataggtttgaaaagtaaagttttattagaaagaaagaacattgcagaagagtgcagcgaggtgcctcagcaagaggggactgagagggctgtggtggatattccttaggcgcatatatgaaccttaaggcaaaagcttgagggtaatttggagcatactagccacgtaggttatgataaatggttacatttgtagttattttggtgccttaatgtcagcaaggattgcacagtgagtttcgcatagaaattctggttactacaaaatttttgaaagacccctggaaccagatgccaactttagatatgtcgatgaagagtcaaactctgtaaaatatttgaagagatttattttgggcgaaatacgagtgaccatggcccatgacacagcacttaggagatcctgagaacatgtgcccaaggtggttcgggcgcagcttggttttatacattttagagaggcacgaggcatcaatcaaatacatttaagaaacacattggtttggtccagaaaggtgggacaactcaaagtgggaacttccagactataggtaaatttaaacattttctggttgacaattggttgaatttgtctaaagacctgggatcaataggagggaaatgtttaggttaagataaaacattgtggagaccaaggttcttttgaagtcttatagtggctgtccttagagacaatagatgacaaatgtttcctattcagacttttaaaagctgctagactcaaaaaaaaaaaaaaaaaaaaaaaaaaaaaggctgccagactcttagttaatctcagagggcctggaagaaaaagatctagctatattaatagagattatttacagatgcagatttccccccacaaaggacagctttgcagggccatttcaagatatggcaaagaaacatgtttttgggtaaaatatttttgctttcttctttgtcacataatgttatgccagagtcagattggaaagcaagtcagatatataggtttaaataaaacccatctgatgagaatttatggtttgtagggcatgactccccagaccccttagataggaatttcagcaaaataaaaagatcagagcttagtcctcataatcaagaaataaccataaaaatgggcaaccctatggagtagccattcttttattcctttactttactaataaattttcttttgctttgcactgtgaacttgccctggattctttcttgtgtgagatccaagaaccctcttgtggggtctggattgggacccctttccggtaacgattatacttctaaattcctcagataaggagtttttgtctcgggctgcttcagggtcaccaggtgatttttgctctcctcacccctttgttcagcttctctgtttttgcctatgtacacaactctcagatttggccactggggagagcaaagttatacctggtgaccatcaagcagaccattcagagacaaaactccttatcagaactccttattcagaagcaattagacttccctattatctaaagcaggcatctcattccaggcttctttcccccaaatttataagtaactagaatttctatgcatctctggaatgcatgcatatcaaaactcacggtgctgaaaatttgcatctgtaaagaatctctattaacatagctggatctttttcttccaggccctcccaatcctgaagagattaactaagagtctaacaccttttgatggtctgaataggaaacatttgccatctgttgtctctaagggcagcgaacataagacttcaaaagaaccttggtctccacaatcttttatcataacctgaacatgagtctcttgctgatattaaggcattgaaaccacctttgcaaaattattacagacagcatcattgcaggaatccaggacactggagtagaggatgttccatacctttgggttacaagccacccccaggaccttgtcctcattgcaaacaagagggtcattgtgatatggaaggggggcaggggagtgctgggtacagaaatgcagggttcctggtgagggctccacccttgggcctgtgcccacagacctaagtaagaacaggcactcctgttttcatgcctgaatgttgtattttccaagaccactctggcccaccacatccccttcctgtgtccatattgttaaatatgaattctaaatttctcttcaaagaattaatatgtcagtatgttcaattctttgacttctgcttttaaatttaacttcctcgtaaagcaacctttttcgattacctgctccaccctgactcattccgattacctgctccaccctgactcttgcaggttacttgctacctgctccaccctgactaattattctccaccctgcataaccatttttttttcccgccaaagcactcatcctgtcacactctttaaatctgccaattggaattagtttagcctgtgcagtctaaccctagccaataggggaacgacacagcagcaggagccttgtgcattagggataagaacccctttccctcccttgtccaggtgtacactcaccattgctctacctgtgagggtgcacccttctatagaagtaccttgccttgctgagaattaaaaagaaaattttatattcgagtgctatttcttttgcggcactgaaactttatatgtaacaatttgggggctcgccctgattacatttccctctggggcagtctctggttctctcttgtgaggagcgctccgccccctgtggcggcctcagccgggagaaatcagaacccacccagtgcgaggaacaacccgagctgtcagcaacaggggggaagaaaactggccggcaacctagcttaaagaatcctcacatactgcagcgacgactctgcgcacagagcaaggaaggagaagccgcgggagctggtaaagtatttccttggtggtcgggaccaaggtaagaaagccacgggggtggtgggcggtgaagtactccttggtcagggtggcttagaggttaaaaagaggtgagacatccccattggcggagattgaacctcacacaaacctccagtagtagaaaaggcaagaaatttccagtggggaaattgagcctcaccccaaaaggtaagaaatttccagtaagggaaagtgaaccttgaaccttatcccaaaaccatcaagatgggaaatatcccaagcaagacagggagcaagggggataaacatggtaacaaagatatccctccagatggccccctaggtctcatgctaaaacactggaaggataatgaaaggatacacataggaaaaagcaacaaatggtaaaatattgctgttttatttggagtcagggacccatcctcagtccctcaatcttctggtcaaagtttgggtcaaatgagaatgtaatgtgtcagcttctaatccgatacgttaatgataaaagtccagtgtctcaagaagaactaggctatgccctttgttggaggcaaggacctgccctcctatttctcttaaaaataaatagggaagaacccaatctggcacctcaaaatgaaaagtcagaggagccagctctcatgcctaaagactccagtgctgcatggtatcccctagaccatcttcccccactcagtgtccccaaactttcccctcagacagccactgccacctcagatcaccactgccacctcagatcctgttccaaattccccctctactcacgctatccctcctccttataaccctgactgttgggaattaccatcccaccagcctgttctctcccaacctaaagacccctctctaaaaagactccagcgtgaggtagaacaatgtaaaaaagatattcagaatttcctatttccctccgtacctaagaggtcagcccctaccctcttccctttgaaagaggtaccacaagttgggggcgggggggggggcattgactttgtaaatgctcccttaatcagttcagaagtccagaattttacaaaggagcttaaactgctgctggacgacccttacagagtggcagaccaaattgaccaattcttagaacctcagttatacacttgggtcaagttaatgtccatcttgggcatcctcttttcagggtaagaaaggagtatgattcttaggtctgctatggtagtttgggaatgtgagcaccctcccaatgaaaacgttcctaccacggaccagaaattccccgcccaggaccccccatgggaaaataacaatgcagatcaccgggaaaatatgcaggacctaagggagataataaaaggaattcaggaatcagtaccctgaacccaaaatctttctaaagcatttgatatacaacaggaaaaagatgaagggcctatgagattcctagacagactgagggagcaaatgaggcaatatgcaggcctcaatttggatgatccccttgggcaaggaatgttgaaactccaatttttcactaaaagttggccagacatttgaaaaaaaaagttacaaaagatagacaattgggaagaccatcccttaagtgagcttctcagggaagctcagaaagtgtatgtgaaaagggacaaagtaaaacgaaacaaaagacaaaacttatgtttttcaccttccaacagatggctccaaacccaggtacttctagatagagtttccagggagccagaaactataaagggtccgaatcctcttttaaagaaccccagcctccatctggaggaccagggtccttgtctaccaagccccctaaagagtatgggggagaagggttaaagaatcccagaactaaggggaggaaggacaaaataggtgctatagatgtggaagagcagaccacttcaggagaggatgttctgaactaagaaaggagaaagaagccctttcactcatgactttcaaggaagaatagcggggtcaggggctctgtctcttttatcttgagtcccaccaggagcccttgataaatttgggggtgggacctaaacatgagcttatcacctttttagttgattcgggggctgctcgctcctctgtttccccccatctaatgttgtctccttcttagaggaacttttagtctccagggtaaaaggtgtaggattaagagcaaaaattttagaaagcactgaagttagataccaggatcgctcagcttatattcagttcttgtttatccctgaagcaggaactaatttactggggaggaatttaatgttaaagttgggcataggtctacaagtcagcccaagaggattcctcacctcattaaacctactcaccaccgcagatgaaaaatatattaatcctcatgtcttgaccaaagaaggaaaccaagggaaactctaagtccctccgatccacatcaagctaaaaaacccaggggaagtagtaagaaggaagcaataccctattcccctagaaggtaggatagtgttgaaacctataattgaaggccttatttaggatgggcttcttgagccctgtatgtctccttataacatcccaatcaagaatcaagaaatcaagactgctaccagccagtcaagaaattagatgggtcataccagctagtacaggaccttagagctatcaaccaaatagtccagagtacccaccctgttgtcaccaatccttacaccattcttagcaagattccatataatcatcaatggtttactataataaatttgaaggatgctttttgggcatgtcccctggctgaagatagctgagatatatttgcttttgagtgggaggatccatactcagggtggaaacaacaatatcgatggaccgtcttgccccaagggttcacagactcccctaaactttttggccaaattttagaagaagtactagaaaaagttgtcatcccagaacaaatatgccttcttcagtacctggatgacattcttatatctggtgaagatctagagaaggtaactgacttctctacacatattcttaaccatctgcagtttgaggggctatgagtctcaaaaagaaagcttcagtatgtagagcctgaagttaaatatttaggccacttaataagtgtaggcaagcgaataatagggcctgaatgaattgagggaatcgtgtccctacccttgcctcaaactaaacaagaactcaggaaatttttagggtcagtcagacactgtcgctaatggattgactcatatacactgccccgtaaactgttctatcaaaaacttgcccaggagaagcctaaccgtctcctgtggacttctgaggaagttgatcaaatcgagaggttggaggaaaggctcataactgcccctgttttaggcttaccctccctagaaaagccattccacctttttgctaatgtggacagtagggtaccttcgggagtgctgactcaagaacacagaggccgccagcagcccgtagccttcccatcaaaggtcttagacccagtcacttgtggatggcctcaacgcatccagtccatcgctgctatggcaatactaggtgaggaaagcagaaaattaaccttcggaggaaaattgacattaaacacgcctcaccaagttagaactatcttaaaccagagagcagtgagatggcttactgacttgagaatcttaaagtgtgaggccattctgttagaaaaggatgatttaacattgaccactgataattcactcaacccagcaggtttcctaacagggaatccacatctaaggagggaacacacatgtttagatttaattgattaccatacaaaggtttgaccagacctgggagaaacccccttctggactggacggcacttactcatagatggttcctcccaggtgattgagggaaaaagacacaatgggtattcagtgattgttggagaaactcttgtagaaataaagtcaggaaaattgcccaacagttgatctgctcaaacgtgtgagctgtttgcactcagccaagccttaaagtacttacagaaccacatctatacagattccaggtatgcctttggagtggcccatacatttgggaaaatttggactgaacgaggtctcattaatagtaaaggtcaagaccttgttcacaaggagctgttcacccaagcattgaataatcttcagttgccggaagaaatagctattgtccatgttcccggacaccagaaaagcctttcttttgaaagttgaggaaataacctagcagatcaggtagccaagcaggctgctgtgtcttctgaaatgcgtgtttttcacttaactccctacctccctcctcctaccataatccccattttctcttccaccgaaaaagagaaactaataaaaataggtgctaaagagaattcagaaggaaagtagatactgccagaccagagagaaatgttgtctaaaccctttatgagggaagtcgtatcccaactacatcaggggacccattttgggccccaggccatgtgtgacgcagttctcagagtttatggttgtataggaatttataccctggcaaaacaggttacagatagttgcttagtatgtaagaaaactaatagacatactataaaatgattacctctcaggggaaggaatccaggctaaaggccattccaaagtatctaagttgattacacagaaatgcctctgatagatcatctaaaatatttactagtgatagtaggccacctcactccctgggtcgaagctatccccttttcaaatgcaacagccagtaatgtagttgaggccctaattgaaaatatagtacccaggtttcgactaacggaaaatactgactcagacaatggaactcatttcaccacacacattattaaaaagctattccaaaatattagacattagatgggaacaccatactccctggcacccaccctcatcagggagagtagaaagaatgaattagactctaaagaaccacttaaccaaattagtcttacagacttggttgccatggaccaagtatcttcctatcaccctgctgagaatttgaactgcaccatggaaagacattggtctttctccttatgagatgctctatggattaccttatttgcactccactgttgatattcctacctttgaaacaaatgatcaattccttaaaaattatatacttggtctatgttctactttctcctctcttaaaactaaaggtctattagcacaggcaccacccttggagttcctggtgcatcaacattagcctggggatcacgtcctcatcaagagctggaaagaggagaagcttgagccagcctgggaaggtccttacttggtgctcctaactactgaaaccgcagtccgcacagcagagagaggatggactcaccacacccaagtcaagaaagcaccgccccctccagagtcgtgggccatagtcccaggggaaaaccctactaaactaaagctaagaagaatttaactccctttcatctattctattactcttttttctttcctcactctattgctgaccatatagttattaacataaccaagtcaatttcacctcaactattgcatttgatgcttgccttgttatatcctgtggggatttgtcaagccaaagaaagctctctacttcagatacctctgtccctcctggctctcctcagactaggcattagtgaatcgggaccatttaatctggggagatttctataaagatcccagtggcaaccaggagtcttcccccagtgatgtagagcttttaagccatagttggtccaaagttctgtggaccattaaagagcaaggatggattgccccaaccagtttttgtaatttcctaaattcatacattcgttttactaaagggacagtgcccactaactctcagctaaaccagtgcaaccctatacaggttattattttgagcccacaaaattcttcctcttttctaagctggttcccttctttaagccagttttatggtatgggggctgaagtttcagggacagaccctattggattctttgaaatgcacttctttgatcccctgctgtctgcacctgcctctgagcctttttccaaaacctctcacaacggaaccattgttcctcctctatctaacgacaaggccaagatagcgatggtagaagttaaagacttaaaacaaactggcaattgagacaggataccaagatgtaaatgtttggttggaatggatcaaatatttcatccacacgttaaacaaaagcaattgttatgcttgtgcgcacagcaggccagaggcccagattgtcccctttccactagggtggtcctccagttgaccgggcatgggctgcatggtagctcttttccaggattctatagcctggggtaagaagttgtgccaagctctctctctgctatatcccgaagtttgacaccttgtgggtcagcccccaagggccatccagcttccatctcccaacactaagtttacttcgtgtctctcatgacagggaggaaacttagtgttccttggagacctgaagggatgcagtgagcttaagaacttttggccaggcgcggtggctcatgcctgtaatcccagcactttgggaggccgaggcaggcggatcacaaggtcaggaaatcgagaccatcctggctaacacgatgaaaccccatctctactaaaaatacaaaaaaaaaaaaaaaaattagccaggcgtggcgtcatgcgcctgtagtctcagctacttgggaggctgaggcaggaggatggcgtgaacccaggaggtggagcttgcagtgagccgagatcgtgccactgcactccagcctgggcgacagagcgagactctctctcgaaaaaaaagaaaaagaactttcaaaagcttaccaatcagccagcccttgttcatcccctagcagaagtgtggtggtattgtggtggacctttactggacactctgccgaataactggattggcacttgtgctttagtccaactagctatccctttcaccctggcatttcatcaaccagaggaaggaaaaataagacatcgtaaagtgagagaagccccttatgggtctttagactctcacttctgtttagacgcaattggggtcccatggagaatacaagatcaatttaaagtctggaatcaaatagctgcaggatttgagtcaatatcttggtgggtgacaattaataaacatgtagattggataaactacatctattacaaccaacagtgatttagtaactacactagagatactgttagaggaatagctgagcaagtaggggctacaggccagatggcttgggaaaataggacagccttagacatgatattagcagaaagaggaggggtttgcatcgtgactaaaactcaatgttacaccttcatcccaaacaacattgcccctaatggaagtataacaaaggcattgcaaggtctcactgctctatccagtgagttagccagcagctcaggggtaaatgatccctttacaggatggctagaaaaatggttcggtaaatggaaaggaataatagcctcaattcttacctccctcgtagctgtaataggtgtacttattcttgtcgggtgctgtgtcataccatgcatccgtgggttggtgcagaggctcgtagaaacggcacttgctaaaacctcccttaactatcctccaccttatccagagaagcttcttcttttggaaaatcaagcagaacaactaagtcaagacatgttaaataagtttgaagagaaagccgtaagaaaaatgcaagaggaggaagttgttaaatatgaattctaaatttctcttcaaagaattagtatgtctgtatgttcaattctttgccttctacttttaaacttaatttcctcataaagcaacctttttcgattacctgctccaccctgactcactccgattacctgctccaccctgactcactccgattacctgctccaccctgactcactccgattacctgctccaccctgactcattccgattacctgctccaccctgactcattattctctgccctgcataaccattattttcccgccaaagcactcaccccatcactctctttaaattagccaatcggaattagtttagcctgtgtggtctaaccctagccaataggggaatgacatagcagcaggggccacatccttcagggataagaacccctttccttcccttgtccagatgtgtgctcaccattgctccatctgtgaggttgcacccttttatagaagtaccttgccttgctgagaattgaacagaaaattttatattcgagtgctatttattttgaggcacagaaactttatatataacaatataaacccgagaccttggcgggcacacacacaagcagctgaatgtcaagaggagtggaggaacggagtggcagagaatggcagagagcgctggagagtggcagagcagcatggcagagagggagggaagaggcgtctgaactttggaagacacctccactcctcaataaagtctccgcatgtatcacttttcaaacagttcatgtgacctgattaatccaggatgccagacaagaatctggggaagttaacattcaggcatccctggatggcaaggctaaaggagcacactgtaacatatgcccacttgggctccagcacctgtccatctgtgtgttcccccttccctcaggggtttgagcagtggggtgaccaaacagacgagccacaccccctgttgcatgtcctgcaaggagaatcagggaactctcctgtttcagttggaagagcaagtgtccctctctctctcgtggtggggagacatctcttccttctgggctgtcacagccccaacctcaccaacctacctgacaagggagtctggcagaacaagggcaagggcagggagaagcacctctaactctattcctggataataatcaagtctctaaaagtcatcctggagccgggcacagtggctcatgcctgtaatcccagcactttgggaggctgaggcgggtggatcacctgatgtcaggagttcgagaccagcctggccaacatggtgaaaacctaactctactaaaatacaaaaaaaattagctaggcatggtggcaggtgcctgtaatcccacctacttgggtggctgaggcaggagaatcacttgaacctgggaggcggaggtcgcaatgagctgagactgtgccactatgctccagcctgggtgacagagagagactctgcctcaaataaataaataaataaataaataaataaataaataaataaataaataaagtcatcctctagggctttgaggccgttcaagcccctattttttccatctctgtggatgagcctctgttaaatctgattgtggctgaacaagagataatgttcctaatagatacagggaccagttattcagctttaagtgtttattacagcccaatgtgctagtcctccatttcattacgggtattgataaacttcagtgaggctgtttcacactgccactcccttataaaatgaaaggctattcctttacccactcttcagtcctgccaagctgccctgtttctttattaggtcacaatttgctcacaaaattacaagcgaatttacagttaagacctcacattctagctgtaattaactcacacttcaccaaaaaagttgctgcagtctatagaacatcacattttaaaacaagtgccggccaggcgcagtggctcacgcctgtaatcccagcactttgggaggccaaggcgggtggatcacttgaggtcaggagtttgagaccagcctggtcaatatggcgaaaccccatccctactaaaaatacaaaaattagctgggcatggtggcacacacctgtaatcccagctactcaggaggctgaggcaggggaatcacttgaacctcggaggtggagattgcagtgagccaagatagtgccattgcactccagccctggcaacaagagtgaaacgctgtctcaaaaaaaaaaaaattgttcttttgtttgcttttctttcaccctgattcctccttccccctttgccgtcttcagtaccaagctacaaagctaggggtggctgaggacagtaaacagagtgtggtcttagctggctttttccctcctgggaagttgttgtttaggatcctaattctagttcagaggtgcattctaaatagtcttctccattgcctttccccccaaaattaatctcacacgttggcttgtgtgtgcattcacgtgaggaactgaactgtcattttcatagataaataagagactgagtttccttagctccaaagagaaagggcattttgctcctcccagcagaaaggtacccgagtgactggggggccttgcgggagtgttggggggttgagcccccagcgacatgaagtgattctgcagggaactcacaacaaaattagttttaaaaaggctcgtccaggaagcacatataggaactggtcactctgagttttgagccctcttggaggtgctagacctccggagaaaacactgagacacctaagagggtggtggcaaggattcagtggtgacacactgtggagtctcatctgcaaccattacacttcgacctactccacaaaaaccctaggccacagctcagttactccttaaaagaaagtgggaaacaaataatctaagaataaggaaaaacaaggtgttgacgaaaagagttaaactgtgtaaaatagttgaagatatttattcagagcccaatatgagtgactatggcccgtgacatagcccttaggaggtcctgagaacacgtgcctaaggtggtcggggctcagcttggttttgtatattttaggaaggcatgagacatcaatcaaatacatttaagaaacacattggtttgattcagaaaggcgggacaattcaaagcaggggtcagggtgagggtggcttccaggctataggctataggtaaatcggtaaatttaaactttttgttttgttttgtttttttgttttgagacagagactcactcttccacccaggctggagtgaagtggcacaatctcaactcactgcaacctccgcccccatgggtttcaagtaattctcctgcctcagcctcctgagtagctgggattacaggcacccaccaccacgcctggctaatttttgtatttttagtagaggcagggtttccccatgttggccagagtgatcttgaactcctgacttcaggtgatccaccggcctcggcctcccaaagtgctaggattatgggtgtgagccaccttgcctggtctaaatttaaacattttctgattgacaattggttgagtttgtctaaagacccgggatcaatagaaagtaaatgtttaggttaagataaaagactgtggagtccaaggttcttttgaggtcttatattggctgcccttagagacaataggtgacaaatgtttcttattcagacctttgaaaatgtgctagactattagttaatctcttcaggattgggagggcctaaaataaaaagatctagctatgctaatagagattctttacagttgcaaattttcccccacaaagtacagtttggcaggaccatttcaaaatatggcaaagaaacatgttttggggtaaaacaattgactttcttcttggtcatgtaatgttatgccagagtcagattggaaagtagtcatcatatataatgttaaataaaatccatctgatgagaatttatgatttgtagggcatgactccccagaccccttagataggaatttaggcaagatagaaaaaatcagagcttagtcttctcacaagagaatgaccctcttttaggtaccccattgattttacggcatctctactttgcaagtgtttgtgtaaatggacatattatggtctctttgtgcacaattatgtcaaagacaatttagagcttgaaggttgacctccagctgtaaagttcctaagttctctatctctctgctttcttttctgcctgttttaagtctgctattatttttctttctttttttgagacagagtcttgctctgtgcccaggttggagtgcagtggtgcaatctcagctcactacaacctctgcctcccaggttcaagcagtcctcccacctcagcctcctgaatagctgggactacaggcatgtgccaccactcttggctaatttttttttttttttgagacagagtcttgctctgttgcccaggctggagtgcaatggcatgatctcagcaaaccaacgagtttctattaatatctcatggctagagttctgagataatagctataggatctttggttgtatgagtatgtatgtgtgtgtttatgcatacatacacttatttcattgtgttttctagccacaggtactgaattggcttaaagttaaagaatattcataaattaataagcctaaatgcttttcaagttcatgtgacttaagtaaaatctttaataagctagctttaaaattattggtaaagtaatattagaaatgtcttaaaaattgttagcataaatttttgtttgcatttattgatcaagggacttcatatactgccaaatactgtaaggtgtcaaaatttggcatagggtttgtaaaactacaaaaccgttcaaaacagaatgatttttgcttttgtaatttttgataaataagacattgatattggtttaatgaaaacagctaaatcatgaattatttagtgaaataacaatatatttaatcttaaggtttttacttagcaaacacctgaaattcacaggctatcaaatgtttgacagggaaataactttaaatgatgactatcacagttttcataactaacctgggtaaactattaaaataaaatatttaggtaaatgtaatgggataaatacttgtagacaaagttgtcataatttaggatctaaagttatgttaaattaaacaatagatatttcattaactgggtttttttaattaaaaaagatattgcaggaaatcattttttttctaaaaaatgtgttcttgttaaaaggaggataatttttgtctaattcaaagcttatttaaaggttatatataaaataaggtaaaaagaaacaagaaaatatataaagaagttatagaaataaaaaagaatttttggtaagaaagcttaaagaaaaataattttacatgagaaagaaccttgtatggtacatttttgtcctagaataaaatgactggttgtttaagaaagaggaatgttcatacaaaccagaaagtccaagcatgtcgtgaatggtctgtttaagttataataagagcatttatggaaaaagacccacaaactttcatataatcaagttgtctataattaaagggaaattatttataatgatcttttgagagattgggttttgatattaaaaaacatttatacactaaagaattcattagaacaacattttcttaaggtattgatttacttttaataaattacaagactatatatataatatattttttcctgcaaagttcaacttttattgcatctcactgttttcagctttctctccccttttaaagtacctgaaataataactctatctttcaactcatttttagctcctgtaagtttttttattttctcctttgtgttctaactgttgtggcctgacgctaataaatgttttatctttgtggtctaaaggaaacattccttccaacataatatttcctgtagggaacagcggttgaaatgcagaaggtgttttgttttccctttgggaaattggcctaataaacagagtttatgctttattgaaataattcctatgtcattattactaagttttggtttgtttagaaaaaaacccgagattaaattttttttaattaagattattacatacatgtaaccctctgtatgtgcttttaaagtccttgtgccattaagttacagagctttgagtccttggtctaaaaagaacaccaagtcctgctaaatattaaacactgacagcagttaaaacctcattttctgacctggtagaagatgccaatcaaaataaactgtgttcatgagacagaaggccggaaattaaaacgattcaactcctcaaggtctggagactatcaaagaagaggtgggtgcatgagattgtaagggccgattttgagagatcaaatgattataaggccaattttgagagataaaataattgagtttctctataaattaaccattaatctcaaaggcacactgatgcaagactagcatatgggctgctgtgtcacgttaacaaggttttcttggagaattaacccactccttaataaaaggttataaaagaggttataaaggttataaaaaaggcttgtggaatttttatcttgtggtcaggatgattaaaattttatagattgtttatacattttgaaaaacaaatttaattggcctcgtttttattagggcttattgtttaggcaattaagtcttctctctcaaagaatcaaggtttttgccttttttttgaaatctttgagttatcaagttgagtaaatgaaagacttattttacaatgacttgatctgtgatcctattttgtgatatcaagcattttatttatttatttatttatttttgagatggagtcttactctgttgcccaggctggagtgcagtgctatgatcttggctcactgcaacctccacctcctgggttcaagcgattctcctgcctcagcctcccgagtagctgagattacaggtgcctgccaccacacccggctaatttttgtatttttcatagagacagcatttaccatgttggccaggctggtctagaactcctgacctcaggcgatccacccaccttggcctcccaaagttttgggattacaggtatgaaccactgtgcccagccaaatcaagcattttaaactttttatttttatttttaaaattttaatattttgagatggagtctctctctgtcactcaggctggagtgcagtggtgcaatcttggctcactgcaacctctgcctcccaggttcaagcaattctcatgcctcagcctcatgaatagctgggattacaggcacttgccaccacacccagctaatttttctatttttagtagtgacagggtttcaccatgttggccaggctggtcttgaactcctaacctcaggtgatccacttgccttggcctcccaaagtgctgagattacaggtgtgaaaggtgtttaaaggccactgtgcctggcctttaaactttttatatttgacaaactttccaaagtcaaattctaacttggttcctcaatgattttttgatattagtcccctgaagtccaaaagagacacagtcagcttatttggcataaaaatcatacaggaagcattgtcaaatatgtaatagtgtttggctttctttgggctgtatttgtataaatatgttattggcatatgttccaaaattatgggaaaatcctataattatgaatgacttagtatatgttattaatcattatcattattatgtaaaattattgtatgctacagaagtaaccaagtttctttgtcaattgtgtctttaagtatgacttttctaaaacttttgtcatccacagttgttttacttttatccttttcaaaaggatgattttacaatcagcataggactctgacagttgctgttgaatacaggttttggagatagtgacactaaaatagagaaaaaaaatccaacactcccatagagagctgaaatatacatgaatagcaagcagaagaggagttaactgcatggactgaactaatagaagactgaaataatccttctatgactttttgcttaaaacattgctaatcctttctttgtttttcagagccaagaaaacatttattttgagcttttaaaaaatttattattattattattattaacaaataaataatcttctttctttttttcttttatctttctctgcagggcaagttctgtatttatagcttttaacaattgaggaaattatactcctataaacaaaatttggagcatatttctctctatctggtttctctaaaatttggaaactagttgggagtattcttaacttatagcaatatagttatctgcacaagtacaataagaatctgttttcttttgtaagaggacataattggggacagtggtgattttaccaaggttttgactggaacaacatgctatcagatgcagactcctttaaggaatcaaagttgacttacagagctaataaaagcatcttgggaaagctggcctcctatcttgtctacacagtccctgtacaggttcctgacctgtggtaagtaaagagtgtcactttctaacaggcccaggagcccaaagtcttcctgaggtgaggaattcatccaattaatacaggtatttgcaggcacaggccgggcttaagacattaaagtcgaatgtgagattacttatggaataaagttccagcaaagccaattaaaaaaaaaacaaggagcctatatggcaaataattattcttgatgattttatgcaaatactccagccaaatataataagacagaaacttattttgcaaatgaattttgttctataatttgtcctcagtgaaaggggactggagagagaaaaaattatgtttcaaaatcacctatagtacacctgttgttagattttagtctcacttagtgtttttaaatttttattattttctatagtttggactaaactctaaaatttttcctggtcacaagtccccaaaataatttttttcattttttttcttttttcctttccttttccccccacattttttcctgattagaaatcaccaaacattaaactgtgctttcctaaagccctgtgaactaaagctagacaatctatttacatacataagctactttcatacctgcctactggtgtatgaacttcagagtaatatggcctatattgatttcccaggattattgttgttgttgttgtttttctcctttcctcccccattttctcttaggacgtgagacttcacaacctgctaaagcgagctttcctaataatgtggaacctacctgtctatgaataaactgtcctagtcatgagagatcagacaaaacctgagaccagaggctaattttcttctaaaatgcttttaaaaagaaaaggggggaaatgtgaaaggaaaataaacttgggaccctcaaatcactaagccaaaacgaaaagtcaagctgggaacggcatcgggcaaacctgcctcccattctaatgggatagctaaataagatagctacaaagattttaaaaagctacatacctccctcacaattttcccacaaggaaattccttgtgtacctagaacagacagaactcaaagtcatccctctgctcatgggagacaaatgcacatctgatggcttcctttgccctattgcttcgctaagccagactaaggcataagtgactattcctgcaagttgcatattcagtggagggctaatcagaaactcaaaagaatgtaacaatttgtcctttatctacctatgacctggaaaacccctccccacttcaggttgtctcacctttctggatggaattgatgtacatcttacgtatttgctgactgatgtctcatgtctccctaaaatgtataaaacctagctgtgccccaactaccttgggcacatgttatcaggacctcctatggctgtgtcactggtgtgtccttgaccttggtagaataaattttctaaattgattgagacttgtctcagataactcttgatttgcagtaagtagcatttctaaacatctctggaatgcatgcatattgaaactcattatgcaacccttgctgacatcaaggcaggaaaatgtctacaaatgtaatcatttagcgtgacctatgtggctaatgtggaccaaattatccttaagctcctgctttaaggtgcataaatgcccctgaggaaaaatccaccttggcactctccatcctatcttgctgagattcttgcctgcactcttctacagagttctttctttctaataaaactttccttttttcaaaccaatactattatccataaattcttcttctttttttgtttttttgaaacggaatctcactttgttgcccaggctggagtgcagtagcatgatcttggctcactgcaacctccacctcctgggctcaagtgagtctcctgcctcagcctccagagtagctgggattacagacgtccaccaccacgtccagctaatttttgtatttttagtagagatgaggtttcaccatgttggccaggctggttttgaactcctgacctcaaatgatccacctgccttggcctcccaaagtgctgggattataggtatgagccaccatgcccagcagtaaattctccttactaatccacgagtggaccactttccaatgctgaggctctgacacctcgctgggcagccacttttgattattttgggttgtcagggctcagggacacaagaacttgctccttaggggagctggaggtctagtagggattgcttgttctccatcaggcccctagtagggaggcctctcctgtccccaatccctgactcccagggatgctcccctccaaaccacagcaggaagttcctccttaggtcagacccacagccctgatgctgtggtctcactgcaggtcatagtctcacaggggcctcttatattattttaattttaattttaattaaattaaattaattttttttttttagatggagtctcgctcttatcgcccaggctggagtgcggtggtgtgatcttggctcactgcaacttctgcctcccaggttcaagtgattctcctgcctcagccacctgagtagctgggattacaggcatccgccaccatgcctggctaatttttgtatttttagtagagacagggttttgccatgttgaccaggctggtctcgaaatcctggcctcaagtgttctgcctgcctcagcctcccaaagtgctgggattacaggtgtgagccaccgtgcctggtcttatattattttaattttaaatttaagaatacattcttaatatcaaccttcaaagactccctgttgcttaccaagttaagaaaactacttaaacctcacatataattcctttctcaactgggaccaataaaccgtgacagctttattgaagggggccagccccttcacacctgtgggtatttctcgtcaggtgggatgagagactgagaaaagaaatagacacagggacaaagtacagagaaagaacagtgggcccagggcactggcgctcagcatacgaaggacccgcaccggcgccagcctctgagttccctcagtatttattgatcatgatctttactatcttagcaaggggagtgtagcagggcaacaggtggggagaaggtcagcagggaaacatgtgagcaaaggaatctgtatcatgagtaagttcaaggaaagatactgtgcccggatgtgcacgaaggctagatttatgtttctctttacccaagtatctcagtgtagcaaagagcaacagagcagtattgctgccagcatatctcgcctccagccacagggcggttttctcctatctcagaatagaatgaatgggaatggtcggctttacacagagacattccattcccagggatgagcagagaagccttcctcttatctcaactgcaaagaggcctccctctttcactcctcctcctcagcacagaccctttatgggtgtcgggctgggggatggtaaggtctttcctttcccatgaggccatatctcaggctgtctcagttgggggaaacgttggacaatacccaggctttcttgggcagaggtccctgtggctttccacagtgcattgtgtccttggttaacagagaatggagaatggcgatgacttttaccaagcatactgcctgcaaacatattaacaaggcacatcctgcacagtcctaaatccattaaactttgatccaatacagcacatgtttctgtgagcacagggttggggataaagttacaagttaacagcatctcaaagcagaaacaatttttcttaatacagatcaaaatggagtttcttatgtttccttttctacatagacacagtaacaatctgatttctctttcttttccccacactttctcacgtgttctttctttctttctttcttttcttttttgagatggagtctcgctttgttgcccaggctggagtgcagtggcgtaatctcagctcactgcaaactctgcctcccaggttcaagtgattctcgtgcctcagcctcccgagcagctgggattacaggcatgcaccatgacgcccagctaatttttgtattttcagtagagacgggtttcaccatcttggccaggctggtctcgaactcctgacctcaagtgatccacctacctcagcctcccaaattactgggatcatatgaatgagccaccatgcctggcccatgtttttcttgtactttaggctttgctacttacaaccagaactgcttaccattctgtcagaagccttccaaccagggcaactccatcttgaataggggctgggtaaaataaggctgagacccactgaactgctttcccagaaggtcagacattcttagtcacaggatgggataggagtttggcaggactggtatcacaagtacaggtcacaaagaccctgctgataaaacaggatgcagtaaaagaagccggccaaaatccaccaaaactacgatggggatgaaagtgacctcgattcgtcctcactgctcattatataggaattataatgcattcgcatgctaaaagacactcccaccagcaccatgagaatttaccaatgccatggcaacgtcaggaagttaccctacatggtctaaaaaggggacgaaccctcagttctgggaattgcccatccctttcctggtaaaacaatgaataatccaccccttgtttagcatacgatcaaggagtaactataagtatgttcagctgagcagcccatgccactgccctgcctatggagtagccattattttattcctttactttcttaaataaacttgctttcactttactctatggattcaccccaaattccttcttgtgtgaggtccagaaaccctgtcttggggtctggtttggtacccctttctggtaataattctgtaagtatttgtagtacgtctgagccaccaaaatttccatactgatccttccattagaatatcctttctgcctgtctctttctggcaggatctgatccatatttcaaagccagtctcaaatgccaccttttccaaagaaacctatccttatatctttatctaatacaaacagtatatattgggagcctaagaaatgcttgttgcatacatcaatgaatgaaccccaaaccaatgtatttctcccttccttgtaatctccagaaatgtttataaactttgttgttgtttatttgtttgttttatttttatttttattttgagatggagttttgttcttgtcacccaggcgggagtgtaatggcgcgatctcggctcaccacaacctctgcctcctgggttcaagtgattctcctgtctcagcctcccgagtagctgggattacaggtgtgcactaccatgcccagctaatttttgtggttttagtagaaatggggtttcaccatgttggtcaggctggtctcaaactcctgacctcaggtgatccacccgccttggcctcccaaagtgctgggattacaggcgtgagccaccgtgcccggcctgttgctatttatttaatatactttatttttttgagcgattataagtttatttttatttatttatttatttatttatttatttttgagacagggtctcattgtcacctcttgcccaggctggagtgcagtggcacgatgttagctcactgcaacctctgcctcccagagtcaagtgatcctgccacctcagcctcctgagtagttgggaccacagatgtgcaccaccacgctgggctactatttttatatttttagtgcagatggggttttgccatgttgctcaggctgatcctgaactcctgagctcaagcaatctgcctgccttggcctcccaaagttctggaattacatgcgtgagctactgagcccggccttaggtttacagaacagcattccacccatgttatttatgcaggggagcacaccacacacatcactttgcagcttcctttctcctcttatatgtcttacagatctttctgtgttctgtacattgagacactcattcattggcttcactcattcatttgaattcattcctttgttcaacagatatttatcgtcagctctatgtcaggcactatgagaagtgcttgggatataaaactgaacaaaataaacaaagtcctttccattggagagatgacattctagtgtaaggagatagacaatagataataaatacaacaaataaataaatacatggtttagtatgttataagatgctttctgtaggaaaaaagtgagagggacctggagtggagggaggaccgagtggggacaggtgcagggtgggggcagccagtagagcccctctgaggaggagtggatcacaggaggatgactggcaagacctaaaggtggcaagctgtctctggtgctggctctgagagcaggatagctggagtagagtgagggaaaggcgaggtcagaggtgaacctgcagggcaggtggggctccttccgctagcgcatggtgttccattatccagatgcaccaggacaaatgtcgcccactgccattactaggtgcttaccatgtgccatcaagaacaataccgcaggccgggtgcggtggctcacgcctgtaatcccagcattttgggaggccaagatgggtggatcacttgaggtcaggagttcgagaccagcctggctaacatggtgaaacctggtctcgactagaaatctaaaattagcctagcgtggaggcgcactcctgtaaacccagctacttgggaggctgaggcaggagaatctattgaacccaggaggcagaggttgcagtgagcctagatttcgccattgcactccaactgggcaagagcaaaaatctgtctcaaaaaacaaacaaaaacaatactgcaataaacattctgtcagtctgtcattttgcccatggacagaatatctgcagaattaattcccggcagtgaacttgagagagatcacccaattgccttccaaaggagctgtgcctggaccatgggtttcagcacaaagtgctgctccctccaacttgtagactcttctggcaggtcacggtggagctcacattctagcgggagagtgtccagggcagagatattccattccgtgtcttttctcccagggctcgcacagagagggttcacgcggtagtcagtaggtgggcagtgcttggtgaaggcattgatgggtggagggattgaaggatgaatgaatggattaggggctgacagtgccgctgcagttactcaaaggagccaccaggaggcgcagggagcccacattctggagacaaaccttttaaaaaaagcatctggtgacttaacgaccttttcaccaatggcttgtgtggggccttaatgctagggtgagaaaaaggtgggagatggaagaaaggggagtgggtaaaaggacatgtgggagaagaaggcagagagagggccttctgagggggcctccacgccaggtaaggaccgtttagctcccctaagagcctgcagcattgatgcagatcccagcaaagccaaaacccccttatgcccacagttgagcccaaaagcccagaacagaggggaaaaataaatttcaggataggccaggtgaagtggcttacgcctgtaatcccaaaacttggcgaggtcaagtaatcccaagtactttgggaggctgacaggggaaactctatctaaaaaaaaaaaataagaaaaggaatttccaggataaatatgtacagtataatcccatttatgtgaaaaaaaaaatctccacaaataaattcctttgtgcgtgtgtgtgtgtgtgtgtgtgtgtgtgtttgtgtgtgacggagtctcagtctgtcgcccaggctgaagtgcagtggcacgttctcggctcactgcaacctccggctcccaggttcaagcaattctcctgcctcagcctcctgagtatctgggattacaggcgtgtgacaccacacccagctaatttttgtatttgtggtagagacggggtttcaccatgttggtcaggctggtctcgaactcctgacctcgtgatctgcccgcctcagcctcccataaattctacatattagtttggggagtgtgtatttaccacatacacatctacagggaaaatctggaaaggtaaatgtcgaattgacaacagtggttacttttgttattgtgtgtgtagagaggggcaggggacaaaaaggaaaatgaggagtgatcaaaggggactttaattttcttttttttttttgagacagagtctcagctcactgcaacctctgtctcccaggttcaagtgattctcctgcctcagcctcccaggtagctgggattacaggcacccgccaccacgcctagctaatttttgtattttattttagtagagacagggtttcggtttcaccatgttggccaggctggtctcaaactcctgacctcaggtgatctgcctgctgcggcctcccaaagtgctgggattacaggcgtgagtcactgcaccgggcccccaaaggggactttagactaaactgaaacattttaactttccaggaatctgtaaccctgctattatataaccacaaattaaaaattactttaaaaaatgaaaaaaaaaaaaaaaaaaaaaaggctgggagcggtggctcacacctgtaatcccagcactttgggaggctgaggcaggaggatcacgaggtcaggggtttgagaccagcctggccaaaacggtgaaaccctgcctctactaaaaagacaaaaattagcagagtgtggtggcacgtgcctgcagttccaactactcaggaggctgaggcaggagaatcgcttgaacttgggaggcagaggttgcagtgagcctagactgcgccattgcactccagcctgggcaacagagcaagactccggctcaaagaaaaaaaaaaaaggaaaagagaaaaaaaaaggaacaataacaacaacaaaaattaaatgctatcttgtgttgcatcaatagaagtcttacgtgcagctcaagggaggtgacagccccctctgctctgctcagaccacacctgggacctcctttcctcttcttggccctgtcccgtgagaagaataatgacagcctaaggcatgctgggggttggagatggggggaggctggggccatctgcacatgatacagatccaggaatagtccctttacccaagcgggagaaactgggcaggtgagcagcttccaggtgtgtggatggcaaatggatgccagactttaggataggaatccaggggtgcagcggatggaaagtccagcccaggatggggcatagttttcccacccagctagggagggagggtaggggctactctggggtgtcaggagtgccgaagcctgaggtaggcgcaagccaggcagcatggcagcatccttccagagggtgttgtgcagctgtggaaaacaattgctgggaggccggcaggggcagtggtggaggagaccagagcttaattctaggtgagtcacaatagcctcatctgtagaatgagtgaggggtggggcgtagtttcagattttttttttttttttgacacgtagtttcgctcctgttgcccaggctggagcgcaatggcgcaatctcggctcaccgcaacctccgcctcccgggttcaagcgactctcctgcctcagcctcctgagtagctgggattacagccatgtgccaccatgcccggctaattttgtatttttagtagagacggggtttctccatgttggtcaggctggtcttgaactcttgatccgcccgccttggcctcccaaagtgctgggattacaggcgtcagccaccgtgccccaccagtttctgactgattttcttttttttttttttttgagacggagtcccgctctgtcgcccgggcgaagtgcagtggcgcgatctcggctccctgcaagctccgcctcccgggttcacgccattcccgggcctgggaccacaggcgccgccaccacgcccggctagtatctttttttatttttattttcaatagagacggggtttcaccgtgttagccaggacggtctcgatctcccgacctcgtgatccgcccgcctcggcctcccaaagtgccgggatcacaggcgtgagccaccgcgccgggcccagcttctgattttatgcagctggcgggatcttgttcttggtcctttaaggcgaccggagggattgcagttttaaaaactcgccagcagaggtcgccttctgacggatttgaccaaaaaatccattccggtgggaaaggggaacctgcgcctgcgattctctctctctccccctctctccctctctctttctctccccccctctctctctctccctccctccctctctcctcctactcctccctccctccctctctctgtctctccctccctccctcccgctctctcccccctccccctctccccctccctccctcccttcctccctctctgtctctttctttgagacaaagtttcactctgtcacccaggctggagtgcagtggcacgatctccactcactgcaacctctgcctcccggggttcgtgattctcatgcctcagcctcccgagtagctgggattacaggcgcccgccaccacgcccggctaatttttgtatttttagtagagacggggttttgccatgttggccaggctggtctcaaactcctgacctcaagtgatctgcctgcctcggcctcccaaactaagattcatttgttgactaagtgaataaaaggggagacattgaagagggggacccgactggatttgggggtgaaggtggagttgagagtgactttgaggcttctgcttgagcaatgagtggagggtgcctctcctgagctggggaaactggggcagcactgacggaggggacacagctacagaggggagaaccctctcctgccggggctgcgggttacagcctgcactgcgattctctgatctcagggacctcagacttctggggccctgtcccctacctctgtgtatgaccctagctggctgagggctgaaggcttgctgttggctctttctgcaccctcagccttctccttcctcttccctctgcaggactctgtcctgggtccttaggaagagtccaggccccaggacagggaagttgggtcaggcctggacctcacattccctgcctgtcccatgaggtggacagtgagaggacaaatgcctggacccctggccccaaacccaagagcagatgtaccggagaagagcttcttagagcaccaggtgccagggctgcggtggagaatcaggggggcccaggggaaggggctgcagatgagggaggagatagatacggagggcctgtgtgcctcccagatacagggctggctttcccagcccagaaggttctttctgcctttcccagtcttcttccattctcatttcatgttcacacttttggccatacccagggtcagccatgaagattgttctcagaatgttttctttcttccttcctttctctttcttttctttctttcttcctttctttctttcctttctttttctttcttctctttctttttttcttttcttctttctctctctttctttctctctctctctctccttccttccttccttcttttctttctttcttctttctttttttgaaacagagtctcactatgtcacccaggctgtagtgcattggcacgatcactgctcactgcagccttgacctcctgggctcaagtgatcctcccgcctcagcctcctgagtagctgggaccacaggtatgcaccaccatgcccagctgattttttaattttttgtagagatgggggtctcactgtgttgctctggttggtcttaaactgctgggctcaagtgatcctcccgccttggccttccagagtgttgggattacaagcaggagcagcacacctggccaatgttttatttaaatcaactcacttaggttgaattagaataattttagacacacagaagagtgtgtctatataattttgaattatatacccaacactcagatataacattagcattttgccatatttgcttcatctatttctttctgaaatattttaatgtaaattacagatatcatgaattttcatccccaaatactttagtctgcatcagtcaaagatatctaatatttaatccacaatggatttccccagtggcaattcccctaaattgtgttttacagttgacagtggatttattgtaaaaggaaactcgatataccaagtgacaagcaagttatcttctgttataaatagaaaggatccctggaaatggacacagtgtcaggcccagagctgtgggtggagacctgctctctgtttgacataaataggagatcagtggctactaaatctgaagacagggcagcagcaaagaacattttctcacggatgtgatgagacttgaaagggactcagaaagggggtcactttctccaggttggggtaactgttatttaagccagggttcatctgcagcgtggggagccagagggtgaccccttccctaggtgatggaggtggctgaggctccagaagtttccagagaaagatctggtgttcctacaaggccagtggcagggggaagggcactagacagtggggctggagggtgtgggcctgtccctgctctgattttgggcactgcacttttgcctgtaagaaggggatatgtgaggccaggacagggtctcctactctgtccccactcccacgccaaacagggccttgaggactctcgcgacctccatgacccagcttccctcctaccccagccccaagcctgtttttgttcccctccctccctcctgcttgatctttgagcctcagccaggatgttacctcctcctagaagcctgccttggtccctggaatggattaagggactctctcctgggccccacagctgcccaggatcactcagcactgtagtgccctgttggcctttgcctccctccagctgtggacgtacaaagcagacagcgaatctgtcttgctcaccactgtacccccatcccctactgcagcacctggcacatagcagtagtgcggcacacttgttgaatgaataagggatcattactactacgcttcccactcataaatgtctgcctcttcggggggctcagaatgcacatttggtccttcattaactcatttactcacaattttttttttttttttttttttgagacggagtttcactcttgtcgcccaggctggagtgcaatggtgtgatctcggctcactgcaacctctgcctctcaggttcaagcgattctcctgcctcagcctcccgagtagctgggattacaggcgctagccaccatgcctggctaatttttgtatttttagtagagatggggtttcaccatgttggccaggctggtctcgaactcctgacctctcaggtgattcacccacctcagcctcccaaagtgctgggattacaggcatgagccaccgtgcctggctcatttactcacaaatatttactgagcacctactatgtcccaagcagtattctaggcactggaaatggggcaaggctgctgcctctgtggaacttatactggggtgtgggaggcaaagaaaaacaagcaaacatacatatgaaataatttaagatgccactcgtggtgggagggactgacaggagctgctgtggaagagagcattaggagggccttgctgaggggtgactttatttcagctgagaggtggatgagaaggcacctgcaggggaagaagaaccaggggaagggtgttcctgatggagcaacagcctgtgctaaggccccaaagtgagcaccagctgggcgctgagggacagaaccaggcacaggctcggttagaggaggtctgaggtcccagaggagacaagagaggggaaggatgggagggcaggcctgagccgcagaaggccagtggaaggttctgagtgggaagaggatgggataggagttatattctgaaaggtccgcctgtgctgggtggaggatgggtggggacaggcaggagcagcccaggctctgatgcagcctccaggcagagatggaccaggggagcccatttcatatccggcccctgtggagggtctgagggtgttgagcagacaggccctggctttggaagtcctgggtgtctggacccgcctgcctgtggggccccagcagagaggaagggaggcggggctcccagtgcctgttgactcatttgcatctgatttgcatgtgaagcagagagtcaggttgaaagctgggaaggcctgtgccagccctgggtagagggtcttgggtgttagttcccacaaagactctgtcccaggccatgaccttcctgttcaggaggggctctgccttcccttgcctccaacgcccctctggcctggccctgccatctggggctgggcagtgcccacggggacaaggtcgtttccttttaggagaggtctgcatgctatgaggacaaaggccaaatccccaccctcgggaacctccttccccagcaaaatcccatctgtcaggctcagcctctgaccttcgacctctctgtcagcacaggctgcagtgttggggaggggagggtccccacccccaaccctaggggagacccaaacctctccccccagccttctccatctgtccccttcggcttctgccacctgctccgtgtgatccaggccaggtcacctccgctttctgggccttggttcccccacgtgtccaatgtgggtttcccaaataccagtgacttgtgtcagtccacttttgtaattgtagccaactccacttactatttcttaagtgaacttactctccttcacttaaatagatttaatttaaaaagaaatgttataccagctctgtaaatggaaaaccagtttcatctgccacaagtagaaacataataggaaaaaataatgaaatggaaataaaacaatgttactctagtctagcctcaagtgaaaaaagtcagacacaaaaggttacatttatatgattgtctagaaaatgcaaaactagagagaaagaaaacagaccactggttgccagggttggggagagggagctgacaatatcaaggggtgcagaaactttttagggtgatccaaactgttttttgatgatgatggtggttacagattgtatacatttgccaaaaatcaccaaagtgtacattcaaagttggtgagttttattttatgtataaaccacctcaaaaagacaaattttagagaagaaaacaaagaaaaatgccggtttagccccaagtctgaggcttcctctctgttaaacaaattagcaaatagaaggccaggcatggtggctcatgcctgtaatcccagcactttgggaggctgaggcaggaggatcacttgaggtcaggagttcaagaccagccatggccaacatggtgaaatcctgtctctacaaaaaatacaaaaattagctgggcgtggtggcgcatgcttgtaattccagctactcaggaggctgaggcaggagaattgcttgaacctgggaggcggttgcagtgagccgagattgcaccaccgcactccaccctgagtaacagagcaagagactccatctcaaaaaacaaacaaacaaacaaggaagagaaagagggatttctctctctgtctctcaccaactctctaaccctccctagttccatgcaccaaggaaaagctatgtgaggacataggagaaggtggccagccacaggccaagaagagagccttcaccagggactgaatcagctggcacctccatctggtacctctaggctccagagctgtgagaaatagatgtgtgctgtttgagccacatagtctctgatattttgttttggcagccggagcagactcatgccctctgatctcatcattagcataatgcctgtttatagaaccatgctgtgggcaggctctgtgctaaaagctttgccagcatcatttcagagacttgatgtgacatcttacatcgtaggggaaattattgttcccattaaagatgggcccacagtgtggctaagccagtggggcatgtcctcagacctggagtgctcccataggaagctgggcccgattctttctgaaggtgtgagctggaggcagtgatggtggtttgagaggcacgggctgtggggaactggatactgagggcagtccctgtgtcccaggggaagcactctgtgctttcaaggggggcactggcagagaaggaagtgtccctcatcacatcctggagacccaccctctggagacagtgttttcacgatttcttttctttcttttttttttcagacagggtctcactctgtcacccaggctagagtgcagtggcacgatctcagctcactgcaacctctgccttctaggttcaagtaattctcctacctcagcctcctgagtagctgggattacaggcacccgccaccacgcccagctcatttttatttttttatttttcgtagagacagggtttcaccacgttggccaggctggtgtcaaactcctgacctcaaatgatctgcttgctttggcctcccaaagtgctgggattacaggcatgagccatcatgcctggccatgttttcactatttctatggaccgtttcataagtgttgtgtggacatagggctccagggttaaatgtgtttgggaaatgtggtgtaagcaaagagaaagaagtttccactctaatacttctcagagactttaatgtggagataggcatggcgaatctctcactgcgggacaagtgggcaagagaagtgtggatgctgccttctgggcactcacagttggtggaggagacagccaacatgcaagcaggggccacaccacatgtctggaggttggaacgctatgcagagagaccacaggaaccatgggggaagtggggagggatttcccagaggagatgacatttgaacaaagatgcaaaggaagtgtggaaggaggtaagggagagctgtatgactgtctgggggaagagaaacccaagcagagggaacagcaagcacaaaggttctgaggctcaaggttgcttggtgcatttgacaagcagaccagcgccattggctggagctagctgggccgagtgggagggtgataatggatgaggttgaccacggtccgctcccaaaggccatggaattcagagcatactggagagcccttagtgggtttggacagacagtgataccttgggacacacagcctcatgagctcatactgaccaaacaaaccacccaaaatagcagcagaaacaacagccacagggtgcagagggtcattcagggtgcctctcacaagcctgggaagtaggcatgtgatatggtttggctgtgtccccacccaaatctcatcttgttttgtaactgcttcaattcccatgtgtcgtgggaggaacccggtagggggtgattgaactgtgggggcaggtctttcctgcgctgttcttgtgatagtgaaaatgggtctcacgagatctgatggttataaaaatcggagtttccctgcacaggctctcttttttgcctgccgccatccacgtaagatgtgacttactcctccttgccttcggtcatgattgtgaggcctccacagccttgtggaagtccattaaacttctttcatttgtaaattgcccagtctcgggtatgtttttatcaacagcgtgaaaacgaactaatacagcacggttaactcccattttacaggcgaggaagctgaagcttagaaagatgaaagaatttgcttgtgaccccgaacgttccctctggctgatgcattgttcctacctgctctgtttccttgtttatgaagcttgcaggctccatggtcctcaaccctggctgctacacactggaataacctggggtggcagactgtgtctccccaggatggccacaccaatacatctcacatcccacatgcttggccaatagcatatgacagatgtgactgtgggttacttctaaagctaggccataatagccatcgcaaccccaccgtgatctctgggattgctagttctgagggaagccagctgccatgtcctgaggttactcaagaagccctgtggagtaggccatttggggagggactgaggcccccaggcaacatctgtcccaacttgccagtcatgttagtgaactacccttgtccagccttcagatgacacctcatgagaggccctgagagagtcttattgtcccgttcaccattcctgttgccctgtggccagctaatcagcttgtggtggttttcatttcttttttctttttgccattaatagcaatgccaggctgggctcagtggctcatgcctgtaatcccagcactttgggaggccgaggtgggtggatcacctgaggtcagaagtttgagacaagcctggctaacatggtgaaaccctgtctctattaaaaatacaaaaattagccaggtgtgatggtgtgcgcctgtaatcctagctacttctcccaagtagaagggcgtgattcttctcatgcctcatgctgaggcatgagaatcacttgaacccgggaggctgaggctgcagtgagcggtgtttgtgccactgcacttcagcctgggcgacagagtgagactatctcaaaaaaaaaaaaaaaagtagcaatgccatagtaagtattcttctaattaagcccttctgaatcagcttaattatttgcttagggtcaatttctaaatgcacagttgctggatcagagtacaagtccactgatacagcatttaattttttcaaagaattgtgactgggccgggcacggtggctcatgcctataatcccagcactttgggaggccaaggcgggcggatcacctgaggttgggagttggagaccagtctgaccaacatggagaaaccccgtctctactaaaaatacaaaattagctgggcatggtggtgcatgcgtgtaatcccagctacacgggaggctgaggcaggagaattgcttgaacccgggaggcagaggttgcggtgagctgagagggtgccagcttgggcaacaagagtgaaactccgtctcaaaaagaaaaaaaaaaaaaaaagaatgtgactatagctggccgtggtggctcatgcctgtaatcccagcactgtgggaggcaagatggtcagattgcttgagtcaaggagtttcagaccagcctgggaaacatggcaaaaccctgtctctacagaaaaattagctgcgcatgggggcagacacctgtagtcccagctacgtgggaggctgaggtgggagcatcacctgagcctgggaagtcgaggctgtagtgagctgtgtttgcaccaccgcactccagcctgggcaacagagtgaggccttgtctcaaaaaaatttaaaaaataaataaatgtaactatattctccttcagtagcaacatctcaatttaccttctcatgcacagtgtttggaaggacatattttgggatgagttttcttttacttcactaccttattttgttctttcatagaatgcctttaaaatgttactttaaaaaaatagataatacctttacaaggtacaaaatccaaaaggtataaaaatgttttctttttttttttggagacagagtttcgctcttgtcgcccaggctggagtgcaatggtgcgatcttggctcgctgaaacctccgcctcccgggtttaggtgattctcctgcctcagcctcctgagtagctggaattacaggtgcccaccaccatgccctgctaatttttgtattattagtagagatggggtttcaccatgttggccaggctggttttgacctcctgacttcaggtgatccacccaccttggcctcccaaagtactgggatcacaggcataagccaccacgcccggccaaaaatattttataaaagtctttcccccacccctttcccctcagtcagcacaagtagccaccactgggaccagtttctggtggataaatccagaaaagttcaggtgcaagtaaacacacatagagagaacaccctttaaattaaatgaaactaaagaaaacagagccataggtgcacaggagacagagagctgacatctggggctgattgcatcttggtttcgagctgagtggcaaaaatactgctaaggtcaacgttctgaaggaggcaaaacccacacgcagaaccagccataggcctgtcaacaaggcgagatgttatcattgctcatgtgctgggtcaggataaggccatacagaccgcccagttctctctgatctgggtgtagttaatgacagtttatccgcctttttcttctctctcaccactccccatggtgggggaggagaaggactgggaggacttgaatactctgaattggcaccaggtgcttaatatagtcctgaaaatagaagaccaatatgctgttggcacataaagatgcccacaattctagaatctgagtgcgcccagatgatctctctttacatggcctaatttgggatcctgacaagttccttctgccctctgcctcactttctcaatctaggaatgggcctctcggtttttgttttgtctaattttaagctctcggctgtgcatggcagaggcaaacttgaagacgcaagggtcagtgagcagggcctttatccaggtatctcaaatatctcccaaccctgattaaagttacatatctcagagaagaatttggtcaacaccattgttgtcattcctggttaataacagggaagttgaggtctgggaagcaccctagtgatgtgttcacatggccatgtgcttctgtaaaatttaccaatgtaaggcatcttaacctcattctgttaaaaccactatctcctttcattccaacttccctttgcatcagatgatgttggggttggtgtgagcagtttgggcatcttgctaaaaggaccttaacatttactttgggtttagtgggatatatttatattgtttccagtcacttttgtgaaaaattattactaactgacctggtattgaaatggcttccaggaatatatccataccgagcatactgagctgactcaacttgtcgtggcatcaagattcaggatcagaggttatatctcaagatatatgaatggtcctacagcactcagttccacaagactgtgaaggagaggtttgaatgtatacacggagccagcagctagtttatggaaagtattacagatgtgtttgagacaggcagctaataaaaagaatgttatttttctgcgttttgtaacgtttgtgcaatttctcttttttttttttttttttttggagacaaggtcttgctctgtcatctaggctggaatgcagtggtgaaatcatggcttactgcagcctcaacctcctggtctcaagcaatcctccctctcagcctcctgagtagctgggactataggcacgtgccaccatgcctgactaatttcttttttccttttttttttttttttttgagacggagtctcactgtcgtccagcttggagtgcagtggcacaatcttgactcactgcaacctctgcctcccagattcaagtgattctcctggctgagcctcccaagtagctgggattacaggtgcccactaccacgtccagctaattttttgtatttttagtagagatgaggttctgccatgttgtctagattggtctcaaactcctgagctcaggtgatccaccagcctcggcctcccaaagtgctaggattacaggtatgagccaccatgcctggccagctaatttctttttaaaatttttttgtagagctggggatctcgctttgttgcccaggctggtctgaagcccctgggctcaggcactccttccacctcgacctcccaaagtggtgggattacaggcatgagccaccttattgtggtttcttgtctctttctaaccaaatcttcactttattacttaatttcatatctgtaattttttcttaaagaggtctccctagggctggacgtggtggctcacgcctgtaatcccagcactttgggaggccgaggtgggtggatcgcctgaggtcaggagttcaagaccagcctgaccaacatactgaaaccctgtctctactaaaaatacaaaaaattagcgggtatggtggcgggcacctgtaatcccagctactcaggaggctaagacaggaaaatcacttgaacttgggaggcagaggttgcagggagctgagatcgtgccattgcattccagcctgggcgataagagtgaaactctgtctcaaaaaaaaaaaaaaaaaaaaaaaaagaagtctccctaggctgaagctacctgctcaatcttctcttgtgtcttataggatcacaggatcccccttgccttacctcactgttactcccaaacagttctcacatgtttacaagggaatgtaacagagtggatcagagaattcattctggatccagaccgaccttagttttctcatctatataatgggaataatagcaggatctctcgccttagatagtcatgaagtccaatgagatgatgtgtataaagccctaacacaatgtagcagagggcacagggccaggattgatatttagctggtcctcacggatacagcagactccctgtttatgacagtggttggctctgatttggttggtgtccatgccagagtgtacaatcattattagctattgatatattattagctccctcccctgcccacccaggggtttacgcagtaagttctcaattattggcaatccaaacaaagaataaaagacaccagctggaatgaaacagagaagctggttccaaattgagcaattcagactgactgctataaaatttcctcaccttaaaggcccttagagttaattcattctaatccccctaaaaatatacttttttgacatgttcaagtattggaaatttggaaaattcacaaaaacacaaagaagaaattaactgctgtgattatagatgattatacacatatacatatgtatttaatacatatttatgctgtacatagtgttttgaagcatactgtacttcaaaaaaatttgggaggggtgcattggcttatgcctgtaatcctagaaattcaggaggccaaagcaggaggatcacttgaggccaggagttctagactggcctggggcaacatagcgagacccgtagcttgacatggtgatgcgggcctgtagtcttagttactctggaggctgaggtgtgaggattgcttcaacctaggttacagtgagctatgattgcaccactgcactccaccctgggcaacagagctagaccctgtctctaaaaaacataaataaaccaatgtttaatacttagcatttccccctatctttaaatatcttctagctacttcacttttatttttatctttttgagatgatctcttgcccaggttggggtgcagtggcatgatctcagcttactgcatcccccacatcccaggttcaatctattctcctgcctcagcctcctgagtagctgggattacaggcatgtggcaccacgcctggctaatttttgtatttttagtagagacgaggtttcaccacgttggccaggctggtcttgaactcctgacttcaggtgatctggtcgcctcagcctcccaaagtgctgggattacaggtgtgagccactgctcctggtagctacttcacttttaatggctgcataatattcctcatcagaaagtgggaaaaattaggctaggtggcgtggctcatgcctgtaatcctagtactttgggaggctgagttggtagaattgctagagctcaggagtttaagatcagtctgggcaacatggcaaaaccccatccctacaaaaaatacagaaaataccgggtgtggtggtgcacacctgtagtcccagctacttgggaggctgaggtgggaagattgcttgaccccaggagattgaggctgctgtgagctgagatcctgccactgcactccagcctgggcgacagagtgagactccatctcaaaaaaaaaaaaaaaaaaagaaaagaaaaagataaagaaataaataaagtgttaataattaaaagtacttttagagggttatgtcataagccttgacaagacttgttctgtaaagctacccggcatgcaaaaagctcaattaagttagctcctccacaggatggaattatataaccaatccctttcaagaggcattgaagttgtttccattattttgctatgatgaataaggctgagcaatattaatctttgctcatatctttggtcatttcctttgtaaatttcgggactgctgggtatgcacattttaaaattaactcactcatcatcatgcagttaggagaacagagaaaggaaggggcttgcaccgggtcacatagggagttagcgtcaaagtcaggactaggaaccagccagggccctctaactggagctcttccagctggggtcctagaggaagtcccagctggccgcgggagggaggaggaggaagggaaagaaccaggcgccggggctgaagcggcggcaggaagaaggtggggccggctgggaggagcgggcggagctgctgagcagcgcctctccttcgggcgggggaagctaagcggtcgcctggcaaccctggcggcgcgccgttcgaacggaagcgaggaaccaatcaggaagtccggggcgaaccattctggtgtgaaggggggcggcgtgctcacttccccttccacggcgccccagggactttccctgcggtgggggccttcgacagtgagggccacccgctcagctcgaccgcggagggcagctccaaaggggaccccaaaggtgcccacgcggggctggggcctcctgggcgtcgttgggagcggccactaccggcccgggtccgagctgtcagcctctccaaagcctgcgcgagaggagccgggacacgcctagcgcgggctccaggtgagggcgcgggtgggtccgggtgcgaccccgggtctgggggccccgttccccgagcgtctgctgtctgctttctccccgcgtcgtacctgcgtgtcatttcacagatgaggactctgaggctcagagaggcaagtgtcccggcccggcgagctctggcggagaatccagttcaagtctttctgccccacctcgcagccccctagtctagtcacatctggacttgccttgagaggcccagacgggcaactggtagtcattttcccagcgttttatcggcagggacctgtagacccctggctggatcacatatccccgcgccccacactgtcctcgggataccccctttgggcgtctgtctttccttctccgcagtccggggttggactcggctcatttggcgcctttctgtctacggggacagaggaccactctttggggatcggacgggactgacatttctgggctggatgcaggggcagcagattctccagcccccagagccgctgctggcctcttgggaatcatccccagtttggggaagggaatagagccagtccctaaaccaaagccactagtcaccagagactttggaattgggagtggggccggaatccccccaggtggagcagctgacctaggccagaccctgctgtgtctcctggggacaccccctgccccctaggttgctattgtcagtctccttttgtaggtggggaaacggaggttctaagaagttaagccccttttcgaagtcacagtcagacaatgcagtggttagctcctagtccctctggcttcaatcttagaatccttgacacacagaatcatgcattttgagagtcttcaatctcttcataagggagttacatatcctctctcctctggagcctgcccctggctttgggggacaggatctccgaggactcagaaagaaaacaaggctttcttttattctttcaacaaatattatttattgacttcataagccctgctctggttcttgcatgttttggtttttttacttattagcaaatgtatcatcttctcccactgtgatgcaaggcaggggctgaggcaattgagccagtgcaaaatttagggatgcccaaaacctcagtaatcaagactgaaactaacgttcatggaccatttgtgtgttctgcaggcaggaggttaactcacacagccttcatgaagtgcagtcctcccatctctctctctctctctctctctctctctctctctctatatatatatatacacacacacatatatacacacacacatatatgtatatatatgtatgtgtgtatatatgtatatatgtgtatatatatgcatatttataaatcatgaaaccactgccctgtccctgagttgctctgtgacattgagtaagtttcttcagtctctgggctgagctaagaagtcatgatggtgcactcaggcctgggcagagggcagtctaggataggaagtgggcttggctgtggatctgcctccccctcccctttctaatcctgcgtgccaggcccttccccaagaccttgcatgtgttatcttccattctgtcctcactgcaaaatccttcatccccattttgcaacctcaagtgcagacctaggcctagaagatcaacttggtatcagtgggcctagatgtccacatccacacccattccacagcctactcccttctcccttcctaatgttagtgcaaggccaccctgagcaaggctgactcctgggcaggccagggcaccagcgtctgggaggcctccagaaatagctcagggcctggtgtggctctggaggtggcccagctgggtgtccctgacctggacagctgggctgaaattgagctggggctgccctgctggctggccccttgccactgcctggagccttcccaatctcctctggggcaggcaagggcctccccaaatctaggccaggcttctgctgaagggaaagaaagaagcaggtgggaggaagggggcgggttgggtgtagaatgtcatgaaaattataacctttggaaaccacacctcccaccccctcaccaaagaataaaaatcactaacacctcttgagcatttactatgttctaagtactttacaagtatgaactcatttaattccctcaactctgtgatataaggtaattactgctgttcttatttccatcttgcagaggggaaactgagcacaagagaggtttaataatttgcataagataacctagaggtggagtttgaacccagagagtctggctctaaattttacattttttgggggggggggtggggtggggcagtgaatgaattaaaatgtatataaaataaaatttaccattgtaaccacttttaagtatacagttcagtggcattaagtacattccccattgcctctccccccagtgcctggcaatcaccattctactttctgtttgagtgaatttgactactttgggtacctctaggtattataaatggaatcataacagtatttgtcttgttgtgtctggcttatttcacttagcataatgcctttaagtttcacccatgttgttgtatgtgttagaattttcttttttatggcggaataatctattctaatattctatgtatatgccacattctgtttatccattcattccttgatggacacttggattgcttttggctgttgtgactaatgctgctttgagcatgaatgtacaaatatctgtttgagttcctgtttttaattgttttgggtatacactcagaagtggaattgctgggtgatcctatggcaattctgtttaattttttgaggaactactttactgtgtttcacagtgactgcaccattttatgtgtccatcagcagtgcacaaagtgctaatttctcaacatcttcaccaacacttgttattttctgtttgtattttttttttggtaatggccatcttcaggggtgtgatgtggtgtctcattgtggttttaatttacatttccctaatgactaatggtgttgagcatcttttcctgtgcctgttggccatttgttatctttggagaaatgtctgttcaagtgactctgcattgttttttttttttttttttttttttgagacaagagtttcgctctgtcgcccaggctggagtgcagtggcgccatctcggctcactgcaacctctgtgtcccgggttcaaatgattctcctgcttcagcctcctgagtagctgggattataggcccccgccaccatgctgggctaatttttatatttttagtagagacggggtttcatcatcttggccagtctggtcttgaactcctgaccttgtgaaccacctgcctcagcctccaaagtgctgggattacaggcttgagccactgcacccagtcatgactctgcattcttaaccattacctgtgcttctcttagatttgtaacctctgagaatagtggatcagctttctgggctgatgaagccctccctcaggagctgggcactggatgatctatttggttgaatagttatcatagcctgcactttggtgacatttgtcatgcatggacctcatgcagagagggaggcactgttgtgagtcctgttttgcagttagggaaactgagatatggagaagttgagtattttatccaaggtctcatagctaatcattggtggagctaggatttgaatgggttctggagtccatgctataccttacagatatggccagggggatggagtagtgaagaccactgcaggcagcagaaccagtgtgtgcagaggtttgtatatggtggctttggagaaagaacaggacttgggtagaagtggtcagagcccagcttgaatgggggtgacttgaagttggaggaagagtaggacaggtctggaaaggccaggagcacggtgagggtttggggaggaggcttggtgcttagggaccctgtccttttttttttttctcttctcacaagatatttattaattacaaagggaaaataataactgtacagtggagaaatttggcagatactgccttaaccaaggaattggctgatcactaagattaagacaaactgttgttatgagtgggtgtggtaatgtacctatagtcccagccactcaggaggctgaggtggcaggattgcttcagcccatctatttgaggctgcagtgagctatggagtgcactccaacctgggcaacacagtgagacctcatttctaaaaaaagaaaaaagaagccttctgataccatgtactaagaaggacacaacatcacttttgtgttattcttgacagatatgtttaactttctctcctttctttcttcctctctttctttcttctctctttcttactgatataagaaaaagctttatacatttaatatatacctcttgatgagtggccttggcctttgaggtgggctgggtccagaacagccggttgttcaacggtatttcctcgtgtttggtccctgaaggaagaaaattggaagggtgtgatggagctcatggtccagtgggagagacaggaaacgagttatatttcctatcctagataagagtatctaaaatgacaggatgtaatgagtgctcggaagggaataaaatgggtgaaattgctgagggggtctcttggaggagatgacatttgaaatgagatctgaagggggtgagggaagaggttccagacagagaacagctggtgcaaaagccctgaggcaggaaagaccttatgttcaggaacagcagggagggctttgtggccagagcaggaaagaggttggagataagatgggagatttggacaaggactgagtcctggaaggcctgagggccaagtggggagcttggattttttttttttttttttttgagacagagtcttgctctgttgtccaggctggagtgcagtggctcaatctcagctcactgcagggagcttggattttattgtaagggagccacaggagggtttaaacacagcagtaatgagactttatttctgctgggaaaacattgccgttattgcccccattttacagcagaggaaaccgagactcagaaccatgaccagggagtgcttcctaaggtggtttctccctctggggtccagccgacgaggcagtagattccttgggacttccttggggggcacatctggtgagtggccaaagcccaacactgaaaacaccgtctcttccacctcccctccccagatgtgagcctgggttccaatcctggctctaccattaatcagctgtgtaattttgggcacgtggccttacctcttggagcctcagttttctcatctgaaaatgggcataataatagtagccctcacagggtaggtgtgaggattaaattagttaacattttgtagagcttagaacagtgtctggtacaaagaaagtgctcagatgagatttgttcttttcttttttggctgtaagtttattcaatgtgaaataatcctctccaattttattgaggtggctgaccacgtccacgaccacatctgcctctaaactggaattcggttgctgacccagccccagcctcggctttcttgtcagcaccagggggcacagaacaccgtctgtaggtatctctgtcagcttcccgtcttgtgagtcttgcaggtcgcttaccctccagacctttaggccgaggcctgccagtctctggacggctgcggtgtagggtggcaggaacaatctccgggggcagatgtagggtggcaggaacaatctctgggggcagatgaaggtaatcacggagatactggctaccctcattggtaaggtaccagtagaaatgtctccaggcaaactgttccttcacgcagccccgggacttgagagactgcatggccttcatgacgtgaaggttgggcacattcttgtctgccagctccgggtgcttaggcatgtggacatccttcttggccaccatgactccctccttaaaaaggagttcatgaatggcaatccggttcttcttaggcatcagcatcttggcagctgtagggtccggggctggggctggaaaggaaggactgttcttttctttgctattacgaaaatcattattgttgctttgctgttactactattagcgcctgaaggagccttccctccccatcccccatttctgcctccgtggagggctaggcagggctcagcaggccatttggaggatgaaggacttgttgccccgtcccctgtaaagtcagggactggaggaggctgcagtgctgagggggaaggaaagctgatgtgcatcactgccggtctcctcatgccctgtaccctagtcctggcccagctcccacaggcacagacatggaacaggagcctcttcagcctgagtgtggcagagggctggggctgaggcctgggggacagctccttctctgggcctcaggattcccatgaaaaaatggcctatcaaatgttcctacctgcagtgagttataggacttggggtggaagaggtgacagtcacctccctctgggaattccttcctgcagggctgcagtctcatgggattaaatgagggggctctggggatttaaatgagtatggtgcctggcaccccaaaattctagttattgttgttactatgacggctgttgttgccgatgttaaccgttttcacaaggcagctgaggcatgctcaggctcagcctgttccagagggatggactctacacgtgacagcatggagcaccaggagggtcccgcagcctggtcagggacacacagctagaaagtggtggcgttaagccttggtctggagggaaagtgcgcaggctggactccccagagtgattttgggctagtgactcagcctctctcagcctcagtttaccattagtcaaatggggtaacaatagaactcaccagatagtgattgttgggaagattaaaatgggttacccgataccaagaaaaacactttcccgtgcctggcacagtgaacatcacctggcggtcgttctgagtgtcagggagcggggctcagtttgtccatctctaaggtgggtgcgcttgcctgccagagccacggggaccccgcgcgccaggtgtgcggtgggcgggtctcggctcccggaagaacttccctgggtggtcctggagcgggtcggacccagttcctgagccaggccagctgccggcggccggggctcgggttctggcccctgcctggctttccttacccttttcgggtagtacctggaccagcgggttcacttgcccgcggccgccggaagttgcgcaaactcagcttgccggagccccaggtgggccgggccggaggagcgcaggccagcggcgcgggcgcagccgggtacgtgcggaccgcggcggggggcgcccagccggggtagggggcggcccgagcacccctccaccccaggacggcgggaacggggcagggatctacctttcggcttcaagaggaccgcggggatggtgccgctctctccctcatttgagagccaggaggggcggcgaggggcaagggtcacacagcgccctgctagccgaccccccatcccccgccaccgggagtcctcaagcttttccggaattgagggagagcaaaagccagcctggggatctgagttccccccagccctgccccgcggcctctggaggctgacgctggggagctagtggggagggggccaggtggggatgcgcgcccccgggatgcaagccagaagggccggcggttgggggcatccgtgggaggcatttgaatccgtgggtggggcattgggcggtgagaggaggcctcagaggggacattgagtcgcgcttggggacttgggaccctggcttcacctggcgggagccgctgcacctccgtttgcccacccgtgacgtggggctgttgaggtcagctcaccgatcagcctctgtcttgggcctgctttgtccgcggtgtgggctgggacagaccctcgtggggcttgcttagagacccctgcgtgggggtggtctgtggacttggttagtcgaaatcttcttgaagaccaggagcctggttcgtggctccgcctttttgccagatgccgaggaaagccctcgacctgtttgatctctccatccttatcgtgacctggaggctcaggaaggtctatttttaacctcgtttcacggataaggtaaccgagtctgtaaagaggcgaagctgcttgcgcaaggcgcacagcgggcgggtgggcgagccgaaggccggcgggcccgcggcgccaaacccggggttggctctcgcatctgtcccggccccgccagaggggacctcagggccagcagatggggccagaggggctgggggcccgatcggggtcgtgcacggggtttctgccccggccccgcccgtctgacctccttctccctctttatccggatggtgcccgcaagggaactgccactgcggacgggttggactggtttgggaggtggcggcctgggggtggggcagagtttggctggctctgctgtgctcctttcctgtcaggtccttcccacctgaggtctcctgggggtcggccctggtggagcgaggcttcctttcccatccactccatctctcctgccttgggagcagcacccaaggatctattcccaactcatggctgctgcagaggtctccagctggtggttgggggccagatggaggaggaggggacagatatgttcgcagacatattttgtttgctgtatatgcaatgttttaatcattattatcgaatatgctgacagttaagaatctagagtttttatgtactcctggatttccagcttcctggaacaatacacctaccaccttggacccatatgcctgcagcaggcagggtacctagatgtctagttcatccctgatcacccagttcacatctggctcccataaatatttcagttcaataaatttttattgaatattctgccctagtatgtgtctagggcagtatcttgaaactggggtatagtgaacaaaatagccaacccccgcccctacacacacacgcctgccctcatggagctgatattttagggggatagagacaacaaagagtaaaacaaccatacacaaatagagtacttgtgcaggggataaggagaaaaggaatagtgccgggagggggtcaggagtgccggggagaaacaggacgtggtattgagatcagtgccttatttatctattctgggacctgggaaagccacttctctgagtctcagtttctccatctgcacaacgacccacaggcttgtgggaggttatagggaggatggcacccagcagagatccctgcctccccaccccaatccagactcactcccttctggatttttggatgtctaggtggggctgtccaatgtagcttcctaccatggatggaaatgctgtactctgtgctgccaaacacagtggcaactggccacatgtggctattgagaacttgaaatgccactagtgtagctcaggaactgaattttatgtttttatttcatttaaatttaaagttaaggttgaatagccacatgtggctgctggctattgagctggacagcacgggtctagatggcttgaactgtaagccttcttggggaacacccagattaagtacccgccccctccattttacagatgagaatgtttgggacttggtatgtgggttttcttctgtcccatctccaaggggccttgtggggtgactctgtgggcttggcccttccttggaaacagggtcagggttggcttgatgtctggggcatcaggtcctgacacttgggtgaccacgtagacacttgtgcatccaggtgtatgccctcctcccaggtgagtacccattccatggctgcaggcagatcgagggtctgccggatgcctccatgcagggctgtgtgattttggacatttccagcttctctcagcacagcatagctcagggctgatgtttccacgtgacaggcatttgtggatcaccgtgggccatccagttccatgcaggaagctgacggatgtctggactccactggggcgcgggtggagattttctttgctccttccctataagctctgccctttgcctggggcctggcatgtctaggcgggtggatggcacagggcagcttcctgcctggatgggtgaggggtagaggtggtaccaggctccctgtggggagtccaggtggggtgtggggctggagccctttttcttggtcatttaaccctacgccccggtgccagcaccttcctttttggtggtcaggggcagagccacctactcgctgggttaacttaagcaagttgtttgcctctctgggcttcagtttctccatccaaaaaacggggctgttgagaggacctgaggttgagttgactggtgcgtagcacagagcctggagcctcccttgctccctttagcgcgtgccttgccctgtcttttctgctcaggttgcccaggtcgcccaggtcttttttctctagcaccttttttcctctcttggtctcagctgggcctggttctcccggggcaggagggagggggtgtgggtggggcctgaggccccgcagctgctgccttgtgcctgctgattggctccttgtggaggggcgtggtctctaccttataatagggagggcgtcttatcctctcagccgcggctgagcctctttgtctgagcgcgctcggcttttttttttttttctctctccttccctgcagcagtggccggtgtccagctgcctactttctgcccggatctctggctcctcatctctccggtctccgcagactaaagccctcgggatatgcagcagccatgcctgtgcacacgctgagccccggagccccgtccgcccccgccctaccttgccgcctgcggaccagggtccctggctacctgctacgggggccggcagatggtggagcccggaaaccgagcgctgtggagcgcctggaggccgacaaggccaagtacgtcaagagcctgcacgtggccaacacccgccaggagcctgtgcagcccctgctgtccaaacagccgctctttagccctgagactcgccgcacagtgctcacgcccagccgccgagccctgcctggcccctgccgacggccccagctggacctggacatcctcagcagcctcatcgacttgtgtgacagccccgtgtcccctgccgaggccagccgcactcctggacgggccgagggagccggccgtcctcccccagccacccctccgcgaccgccgcccagtacctctgcggtccgccgggtggacgtccgccccctgcccgcctcgcctgcccggccctgcccatcacccggccctgccgccgcctccagcccagcccggccgccgggtttgcaacgctccaagtcggacttgagcgagcgcttttctagggcagccgctgatctcgagcgcttttttaacttctgcggcctggacccggaggaggcgagagggttgggtgtggcccacctggcacgggccagctcggatatcgtgtccctggcagggcccagtgctgggccgggcagctctgaagggggctgctcccgccgcagctcggtgactgttgaggagcgggcccgggagcgcgttccctatggcgtgtcggtggtggagcgcaatgcccgcgtgatcaagtggttgtatgggctaaggcaggctcgggagagcccagcagctgaaggctaggcgccactgggcctggaattcgccacaggacggatcttacagaggcaagtggtccctggacctctcttgcatccattctctagacggccgtgtcagaggctccaccctgttgtgaacttggtatggaggcaaaggcttagaggctggaccagcattgttgggcaaggactgactctccaagggttttgttcttggctttggacacctgagaaccccctcctcccctcccccaatacaaggtttttgacatgagtgtactcctgcttagttcctcttgtggggctgcatttgcggtgctttgccctccccactgtgagtgaggggccaagggatctcctcaatcctgtctccccagcggctctgtttcctccttccttccttggcctctgtcctttgctgacttcctcttccttacccagcagaactcaccctggggtcggggcagtggggaggggcctatccactgctcttcctagtccttggcagctggcctaggtgggcagactataggagggactggttaggagtctgcattgctttgacttccctctccttggttaataaacacaaatgcttgtttctcaagggctgggccttcagactcttctgtgttcacaagagaaagggtgagagaagtcttggggtggggccatcaaaacagtaattgttcaccccgaggtctagtggtggggcatgatgatagcggctggcctggctggagacatgtccccgtggtgggttctcataactctcctggaaggctagcaggcctgcctcatcgaggaggaaactgagatccagccatgagtgagctggaatagagctgggagtaggaatggggtctttcccctgcaccagaaagggagcctgcaggggaaaggccgatggggtgcatagactctccccaaccaggagtgttccatccaagccctgcccagttcccaagggggcaggaagctcggagagggcaaatcctgaacttgaggtcacacagaccatagagtgaggatgagaagtgggagttttggaggaagagagacttggggtggacggcacaaaatgagtggcctccctggcgatcttggacaagccagtttccctctgggcctcagtgggagagttaggcagcacagtcctccttgggttggggcactggtgcattctgggcccttcatgctatattccaatacctggggagaggggaaggaaggggctggcactgggcttcgaggcctcagcttcttccagtctccctccaggtcagttacctactaggacaccccaccttggctagtggagcagctagggctagagctgggcctacaaagggcgaaagcgggggtggcctctctggtgccccacggtgggcgtggagagggggtgggtggcgcttcctttcacaggctgccttggctgcagcactcagaaacaggaagctctaatgggggccctggtgacaggtttgatgtaggttttattttaagcataaagaggagatttccgttggactgttgacaaacatccacatcagcccagctgtccatctctctgtctgtctgcctgtctacaactagcccccaggggcctgggatgggcctgggcagtttggggaaggaagggaaaattgggttctagaagaagatggtgttccagctcatgagactggagctcatgatactggtggggagacaagcatgaggagggtggtgacctacccacaaccccccatggtgcccagcagttttgacaatgcaggagctgggcctccagggtccccatgctgaaggagtgatggtgtcaggagagagaatccaggcaggatctgcagacgtggtgccctttgaggtgtcaaagactagatttcctaggcaaccctgctagaattcagggctagtcattgccccttgctgtgacctggcagcctccgagtaacccaagaaggtggatgggctggctgcattttacatgtgaagaaattgaggttcaggtcacaggactggtgggtgacaccttgtttctgaaggagggtacagtgcttgaatcctcaaggtagccttttgaggaccagatatattgtcagagcaggaggttgagctcagggaaggatagcgacttgtatactgtcacatagcaggtctgcaggacagcctggggtcacactcttgcctgccagacacatcgcagtctggattcctggttctcccagcatgtaccccaccactcttcctcatcttggcagccttttcttctggtcactttattactgagcatctactgggtgcccagcagtggataagacagacatggcccctgtcctagtctggagaagagaatgggcaactaaacattcagcacataaataatcatagaatgtaaagcaggtatacttagggacttctgccctaaaaccagagctgttcccaggagctggaccaggggatagctgaaaagagaacgcctttccataaatccactgggagggtctgttggggagagagcagggagggattcttggaagtggggaaggtgccagattgagtcttctccaatggttatggcttggtcttgggagggctccccctgttccaggattctggagcctcccgccttccctgcaggcctctgtggagggagcagggcggggggcttttgcactcctccctcccccaaccctgcagccttggggatctgtggaaacagcccctctattgttctgcctccagttggagtgtgagccctcggagggcctgcagctgctgccctgtctcctggggctgcccagccctccgaagcagctcccccaggccagcctggccccagctgcctagcccctaattaggcagagatgggatctgctctctgatccatttcccaccagctaattatatacacgtggatttgggaaccaggcaacctggctgctcacttctatcatgaaggtggatgggccctgggaaaggcagccccccccccacagacctcagtttacccttttggcagaggatggagtgtagctgcagaggcctgttccctgtccttggttaaatagttctgttcctgctactgaaacatttaaggagaccccccacccccatcttacctgatatcctgtgtacaggggaccaggaaagggttgaggaatttggctataggtccttgactctaggaccccagggtagggtcataggatatagatgagagcatggctgcagctggctgccaattagatgtgcatataggagggcttacagttgtgctggtccatctgggtggcctgaacacccggccgggtgcggtggctcacgtctgtaatcccagcactttgggaggccaaggcaggcggatcacttgaaaccaggagtttgagaccagcctggacaacgtggtgaaatcccgtctctactaaaaatacaaaaattagctaggcatagtggcggacacctataatcccagctacttgggaggctgaggcatgagattcgcttgaaccctggaggtggaggttgcagtgagccaatatcatagcactgccctccagcctgggtgacaaagaaagactccctctcaaaaaaaaaaaaaaaggagtgaacaccccatccaggtttttaaaaaggtaatattggttgatgggtacagcaaaccaccgtggcacatacatatctatgtaacaaacctgcacattctgcacatgtatctcagaacttaaagtagaataaaaataaaataaaaggtaatattatttttcagataattcactcatatatttcttccaacattttattaagaaaaatttcaaacatagagttgaaagaattagacagtgaacattcatatacccacctactaatgcacacttgttaatatttcactatatttgctctatcaggaatctacccatctctccatccattaatacaacttatttttttaatacaacttattttttaataaagcttttcaaattaagttgcatatatcagtacacttcccttaaagtcactttagtgtgcatgccattagctagaattcaatatttgtttgtcttgttcctctctaggtaacatttacatggaatgaaatgcacagatcttaaaggtgccatttgctgaatttagacaaatgcatactgtaccccaaacccctatcagggtatcaagcattatcacctcagaaagtttccttgcatcgctctcctgccgattgctgcctgcccaccatggacatatttttatatccatatatatcagtactaacaagcagcatcccttgtcctttcctctacatcagcctcgctccccaaaagcaaccacttacaacttcttaaactatttcttctggtactttcctccatatttttaaataacttgcttttcctgctgttttcttgatcaattttaggcatacacacacacacacacacacacacacacacacacacacacatatatatttattttttttttgagacagaatcttgctctgttgccccggctggagtgcagtggtgtgatcttggctcactgtaacccctgcctcccaggttcaagcgattctcctgcctcagccacctaagtagctgggactacaggtgtgtgccaccacgcctggctaatttttgtattttttgtagagatggggtttcaccatgttgaccaggctggtcttgaattcctgacctcaagtgatccacccaccttggcttcccacagtgctgggattacaggcgtgagccagtgtgtctgaccaattttaggcacatattgactgactttctggtctgatgttttcatagtgtggcctccactgcctggctgcctggctttggatcccagcccttcctctttctggctgtatgaccttgggcagtaacttaacctccttgggcctcagttttctcatttgtaaaatgagggtgataataatagtgctgaggttattggattgttatacggattcaagatgtaaaaggctgagaataatgaacatcacccagtgagtagtcaaactttttcttctcataatcattattatcaagaaagatttagcttttggttcccccctttcaattggcatttatcacaattttttgtgaagtggattttagtgttatttatattatgactatgtaaatactgtttcctttcaagccaagtcatatattttggttacatttcctttcttgtacaactctttgttcttcctggagttactactcgctttgctttttttcatttgctgtttcctcttaacccatccttaattctcttaattctttgacaccctcagtctccccatagttaacattacacatcctgaaactcttcaagtgcttttaaagaagcatccccatccatttaaaaaaaactggagccaatttttaaaatagaatctcaaatacaatctgtaaaataaagatttgtgagcatccactatgtgccaggagctgtgctaggcagagtgggaaggtagccaaataggggatatccctgcccatgtgggtttccaagagggatgaaaactgaagctccacacccccagcctctgcatttaccggggaacacctcagcacctctaggaatctcaggacctcagggagcccagatttacttatttgtaaaatgaggatcattttgtcattctgcaatcactccttaaccatgttgtctggggctgtgttgtggctgctgggtatagagcaatgatctccccatcccttgaggggctcacaagagctgtgggatagagcggaggctgtggattgcagcggagcaatgggagctggggagcgggtttcccagaggaagtaccataggacgaagagggtcttggtgggtaagggcagtaaacggctgttatgttccaagggctgtgcgaagaacttccatgtattgtcccatcaaatcctcccaaagacccattgaaaggggtcatatttttatcacaatttcatagatggggaaactaaggccaggagagtccaaggccagggtcacacagctaataagcggcagaggcagtatttgaacctatgcagttgggttcttaaccacacactgcactgtctctcacatccagatgcccagctcctgtccccacctcatcctgtatctgcctcgtcctctcctgtctacccactggtgctaacctctggctcattccatgcccttcgctttattcatccattcattcaacacaaatctactgggcgccttttccacgcccaaccctgggctgggcagtgccagggacatagagcttgggcagtattgactcacccattcccagataggcattgacattgacatgcaagcggccaggaaagttgtctaaataaaggggtgtttggggttgagtgatggctgtgtgtatgtgtgtgtgtgtgtggcctgcaaggggtgtgtgtcagtgtggcagcaacagactttctgtggaggccatttatgaaggcatatctgtgtacccttgagagtgtgttgtctgcagagggtgtgtccaccaggtatgtggatcagtgaggctctgctgcataacaaaccactctaagcccagaagcctaaaaccacttattagcctgtgtgaagtggcagtctggcctgggcttagctgggcagttctggttttacctgggttcacttgccttgctgcagtcagctgagggtgggggctctgggagggcttcactcacatgcttagcagttggcaggctgtttgctggggtgcctccatttgctttgatgaggctggcttgggctcatgcttatggtgacctcagggttccacattcagcaagagaagataagctccaacgcacagtgcattttgagcctctacttgtgtcaagattataaatgtcctaatagcccaagtgacatgtcaagtcagattcaaaggatggagaaatagactctctctctctctctctcggttgtgtttttgttctttgaaaacaagcccggcttgcctggctccatcgcccaggctggagtgcagtggcgcgatcttggctcggtgcaacctccgcttcctggttcaagcaattctcctgcctcagcctcctgagtagttgggactacaggtgcgtgtcaccacgcccagctaatttttgtatttttagtagagatggggtttcaccatattggccagactggtctcgatctcttgacctcatgatctgcccgccttggcctcccagagtgctgggattataggcatgaggcaccgcgcctggcttagaatccatctcttagtcacattacacagggcatgagtacagatatggaggaattattgtagctgattttcaaacaacttacctgtgtgtgcaggtaaagaactagggacagttctcagttttggaaataaaaaaaactctgggctgcagtcctggctcttccgtccttgctgtctgaccttagtcaagttgtctcattctctgagcttccgtaaattggataaaattgaatgaaacgagatgatctttataaagtgcttgtgctactcatttgtttacaaacgcagcacatatttattgaggcctcctatataccaactactggtcccaccccgaggatattgcagtgaacaaaatggaccaaaacacctgctcttgtgaagctcacagcctaggttgtagacagatgttaattgatcatcctaataattgtatgaccattgagagtagattccggaaggagagattgctgacctggccaggttgatctgagaagccaaagatatttaagctgagatgtgaagggtaggtaggagacaacgaggagaagaaagataggagtggaaaatgattctagatggagggcatgtgcaaaggccctgtggtgggaggagtagattccaggaacacagagaaggtgggtggggctgggcctgaagcaccagggccagatggtgtggggctgctggagcctttgaacaatgtgagggtctgtcttgccaggcagcctaaaataaaaccgaaaggcctaactgctccacaaggccctcatgatcggggaccttgttactcctccagtctcccctttacctactctgctgcagccatgctgcctccttcctgttccaggaacaccctggacacattcccacctcagggcctttgcacttgccattgcctttactagtatcgaccctacccagatattctgatgactcattctgtcacttcatttccatctctgcctcttcaaaggggccttccctaccaacccaccacaacccccctgcccctccagctaagcagtcagcatccagcagtctctacttccctggcctggtttatttctcttcctagcacatatcacctcctggcttatattaaccagaggccacattgtctgtttctcttctggatctctcaccagagtgcagctcagcaggcagggacttggccttgctctaggctgtgtcctcagcctcaggggaagagtaggcattccataaacatttgtgaataaagaaatgagtgaaaatgagtgagtgaatgctggaaagaactagctcctggaaattaggaggtctgggttcaagttctagctgggcgatcctttctgttccttggtttctccagttgagctgtgaggcatttgtggtctctagggaggttctaggacaggaaaggagtactccaggctgtggagggggcctatgtaggaagaagggagctggggccttccctttggccttctggcgtttgaaaatagcctagctcagcccctagcttgggcccctaccctccctggggtgccaagctggagccagggggctctgtctggagcctgccagcctggtgccgggctgggatcaaggccacctgacagctgggccaggcagtcctggaaggttcttaagggcaaacagggcatgctggatgtcccagacctccctccccacctattgtccctcctccctcagtgtccaccggcaggataaatcccttcatcctctacaggcctgcagcccttgcagcttgcaaatctttttcttggtttgtttctaatttcacccctgctcagtagctactttactggtgaggacactgaggctcagagatgacaactgcctcactgaggttacgttgcagttatgattcaggcccaagtcttgcccagccctgtcctgtcaccgcgtgcacgtgtgtgtgtttgtgtttgtgtgtgtgtgtgtgtgtgtgtgtggtctcactatcaaacagtgccctcccttaaccaccagtgccccgggtctctgataagatgtgatgactatgagcacctggagccaggtggcctgggttcaaatcccacctttgctacttctatactgtgtggattgctgggccacccccacctcagtgtctgctaataggacaaatcccttaatcctgggcactggggcactatcaggactagcattgtatacattgcacaggttttaaaaaatgtaatctgtaggctgggcacagtggcttacacctgtaatcccagcattttgggaggcccaggtgggtggatcatgaggtcaggagctcaagaccagcctggccaacatggtgaaaccccgtcactactaaaaatccaaaaattcaccaggcatggtggcgggcacctgtagtcccagctactcgggaggctgaggcaggagaatcgcttgagcccagaagctgaggttgcactgagccgagattgtgccactgctctccagcctgggcaatagagcaagactccgtctcaaaaaaaaggtaatttgttgtcaatatttacacatctaaaccattggaagaataatgtatatataaactagctaatgaacacctaccaagccccaagcaccaactgtatgtccagtacagagccagctgctccaggggagttcgttcctgggagggggcatcatgatgaagtgggcgtggttcccatttcctccagcgtagtctcagaagcgggaagccatgtgactgaggttacagccagggagggcagaggcccccggcactcacccctctggggtccaagccccgctggcatgtgttgtgtccctgggtaggtgtgtcactccctgtctgtgtctccagtgttcctgttggcaaatcaggggtgggacggaggtaaatggagaggccctgcccagtctgctgtaatccaggatctcggacttagtggggccaaagcttccaagttctcctgattagtgaggctgcaaaaaatgtttggcatgttattctctcaccgtttaaatgtgggcaagtaacaacttacatgtaaaattacccccatataccaagcatttaagttatttattatatcattgcttacaatagcaaataattggaaattatttgagaaatggctaaagaaactcaggcccaggtacgcaagggaatcctaggcagccctcaaaagatgtcctgcaaacacctgatgtggaatcacaagatacacaacacaggtcagtgaacaaaacaagttgtggcatgatacccacagtgtgctgctgcttgtggaagcaggaacacatgtccatgtactcttgtactggcacagaaccctggagaattatcctgggaaccctgcatgctggctgcccctggggaggggaacccgagggttgggctcaagggtgggaggcaagactcactactttgcacaccttttgaattttgaatcatgtgaatgtgttatctgtgcagaaaaaataaaaatacatttaaagtaaagtgaaagtagacaagaaacctgaaacagagacggacaagcaagcctgcaggcccagccagctaccgcccccgggcaacctcatgccacactgtgggctctgcccagcttggttttgtggctccaccctctacggtcatatttgggtttccacacacacagcacccaaaggaaatcccagctaacgcacatcaggttctgggctgggccacccgccaaggtggttggtgggcatgacaccgccccgggaatggcgtcgtccaaatgcctgagcaatgacacggcctcagatggaatgatgccactgcccacagtctcacaggccctcccatctcgcctttgttctgcagcctccaggtgggtgtatggacactccaaaacagccatccctgtcaatgaatcagcctgcagggactgaattc

SEQ ID NO: 147 - DNA, 516 bp, Homo sapiens
aagaggacaatggatttgtttttattaatttttttgctaagaaagtttctaggtggcaggtgctgtccggggagggggcgtgcgcagcagacacagcagccaaactgtcctttctgcttccgtctgtctgtgccagccctgccgcctgccagctcttgctccctcagagccagaaggttcttggctccaggcttcctggcctggatgctggcagcccctggggagaggacccaggccccctctagtaatggccaccaccctccccccagggcagctggagcctcatctttggcagggtcccctctcccttttccaggagactctgtgcctgtagccctggtcccagtgaacctggcccccaccccagtggctggaacaggaaggccaggaggcagatgggccagggccaggagacagatggcccaatcccctgcccaccacagcagcttttctgagaggcgggcaggggcagggtttgctccccctggtgctgggatgtggtagagacattgcagc

SEQ ID NO: 148 - DNA, 511 bp, Homo sapiens
ttttttttttttttcatgagcagtgggctaccattattaagcacttagtgtttgcccagcatggtacaacaatctggtaggtgggtagtttatctccaatgacacatggggacaagaggataagttatcttgcccaaagtcacacagccagtgagtgttggaagctggattcaaacccagacgtcagattccagagtccattcttttcaaggctggacttgaccccaccctgacccagggcccagatttgagggctctctctgagcccacctgactttcctccagggtcaaggctggctgggtcccctggagccctctcctccacccccacacccagaggacaggctgcatcaggggtcttcccacccccaccccataccaaggctgctggagaggagcctggcccaaggtggcgctgcccctcttggacctccaagaatgccgcatggagcagcccctcagggctgtagtccctctacacctacattgggcccctccagcctggaccccc

SEQ ID NO: 149 - DNA, 434 bp, Homo sapiens
  misc_feature (1)..(434): n = a,c,t, or g
atatcatgaaaaaagatttagagaattacaagagtttaggttaataggaaacacaaatggaggtggaaatttaaaaacaaaggaatggaactcaactctccacagattgaacccacacaggtgtcactgtttactgaattagcaccacttttgtgcagtgaagacacccgtggctgagatttcttaaatctcactttttccatgcttttcttctgacaaactgaccacggagggagagctctcctcccccctccctatcccagactgctgctgctttcctgcaattctggtggtctttttgttgcctcatctgattgagactntggggaaacaacacagcagcaaaccaggacatatattccctctaaaaacagcttgaaaattacaatacanagatctcaataattatgagatgcagngattntttctttttt

SEQ ID NO: 150 - DNA, 880 bp, Homo sapiens
gatcctcaaggcctgctctgccccgtggagacgcttgctcggatgagctcaggaaacagtaccggctgcgtggcaggtctgggtgttgtgtgcgaggacgtggcctttgaacaccgctgtgttctcagaggtccttaggagatatttttttttgtcttagggggactgtgttaagttcagacaaatcatgctgggtgtggagagagtctgaaatacgtcagtgaagtaagtagcagtgagcgattgtgaatgtgtaatgtaaatggaaaaccgggttttaccgtgttaagttattcactagggagccagtcgtagttctttgtaatcctctttcttccaaacctgctttgctgaaagttgcagaaaaggaagtgtgtggagagaaacagaacccttcagggtgggtcagaggacgccatccacagtggattcgtgttcgtttgcaggtggaagcagtgatttttaggacccactgattaaaaacaaacattcccaagtgtctctgagagatgctgtttatttgttaattaaaaagcttttttctctgtcttttaaattatggtttcatgtaataaggatatttttagtgaaaaatggttttcctttcaaattacagaccttttaaaaaaacttaatttgagcgagtaccttttcattgacactttcctgtttctaaccttaggaacagaatagcgttggagacacgacgtttcagttactttgaaacctgccactccattggttgtgatgctcctttacataatttctgggacaaaaaaaaagggggggctaaataccgggggccagttcgtccgtttgtaagggcccaagggggtaaaagaggggggtaaaggggagaagggcttggacccccggggag

SEQ ID NO: 151 - DNA, 514 bp, Homo sapiens
  misc_feature (1)..(514): n = a,c,t, or g
tttttttgctcttagaatagactttattgactttagccaagggcaggccctgagatgggggtccagagagaggggcttggtggggctacgtcctgngggccaggttggttctgaggggtagaaggccatccacccactcgcacggctgctccaggagggcttgccacagctgcttctcctcaggtgtggaatccatccagggcacctgcagcccatagctgctgccggtgcccaggctgaggcgtgtgccccccagctggcggttggccagggccccatggtcccagagggagagctcggcacaagcctggcgcaggtcagcaggcccaaagccatcgtacaccatggtgtgattgaacacagggctgaggctgcgtcgcacaacccttgtacgctggcggctggcctggctgtcatcaggcagcacgaagcattgtacgtaagtgtccagggatcctgcccgcagcggcaggaggtccagagcctccttcacccagaagtgcagctccccgtt

SEQ ID NO: 152 - DNA, 742 bp, Homo sapiens
  misc_feature (1)..(742): n = a,c,t, or g
ttttttaacatgattgccttttatttattatgcaggttgttgatttacatagggagttggagatgctaaccaagcatggagttttcacatggtctatttctgctgagttcagggacttggagacagcctttaacttctggcaaaaagacaatttcacaaaggtgtttaaaaccatcctttggtttttgatcctgagtcagagacggacatgtgcttatgaaagaaggtagagtttcaacccttaggtaaccttaaaagagcaggaactatgttgtgtgtaagtcatgtgcagtatacaaacttgatattaaatgacaaattggaacaatctttctctaggaatgcctctctttcatagaggcatcacagtgagtctcttaaagccttgatctaggtgtgttacagatgggcttacagagtatgaatgcacgataagaaggaaattggatagggagtgaggatatgaaatttaaaagaaggaagaactggaacaaggcataggcctctttcaatttttcgtggtgtgcagctgccaattcttggacattcaagaaacgctggttgacattatcttttttcttcacaatctgatcaacgttgaaagtcccgctggagagcaaatcttcagccaatgtattcaggtccttgagtgcatnctctcgagccaacatctctctcttncatagctgatgcttcttgagtaggtttctgctgaagccaagtcctgggctgatctttatgg

SEQ ID NO: 153 - DNA, 536 bp, Homo sapiens
ttttccaatttgatttttaatgtaattaatagtgatttaattttcaaaggagcaaataattacaaacaagagaaaacattgctgagatggtgcctggttgcttctattcaggccattgctgaactatatagaaaaaaagtatattcatggtgtcttcattattatgaaaatcacagtaatatgactcatcaggaaatcacaataattttatgacagaaacaatatatttagaacgaatctgtcagtatttgactctcttttgagggaaaaataaatgaaaaccacgttctctggaaagaaataagacaagaaatgcccacagttgcattctgctgttgggaatacatctccaaaattcaaggttcaaaggttatcacatttaattttcaacacttatcaccttcttcttctctcaatttatggagatagatttctacgttcattattcgggattattagaaatttccttcagtttgaacaatgcgtaacaagtattctgtgacatgggtgcaaaaagttgtcattttcaatcaagt

SEQ ID NO: 154 - DNA, 653 bp, Homo sapiens
  misc_feature (1)..(653): n = a,c,t, or g
ttttttttttttttttgttaatggaatgcacaaaaagtgctattttaatagagagacacaaaatattacatattcatgggacttagggacaaaactatgccttggaaattttctggaaaatcacataagctccaaagaagttgatacaaaggcagctaaagatcttggtttgatagtggcaattctaccaatacaaatacaaaggaatcaacaaatggacaactctttagattacagttatgacacaagcaatccacaggcattccagtgaaaactgcacagagctctctctgttgttacttgcaaaaggctagcatggaaatatcttgtgttcatgtgaagagttggcccatatttccttgcgtgttatcacaagcaggctaaggggcctccagtccttatgacataattagaggagagctgggaggaatttccagacaacagccaccttcaccagccagcccttttgtctgatggtccacacaaaactcattgtatgagtcagcaggatctagaaggttcacttcctccacagtggccgacagtttagatgaatccttctatatgtttctgaacccagacccagccaggacttgtctctattcattntctgggctggtctaacaggagataataggctagagagagatgct

SEQ ID NO: 155 - DNA, 530 bp, Homo sapiens
tttaagttttccaataaatttaatcaataaaatatatactggaaatatcacataaaaattaacttacacttcaaagattgtgcagctgacaactcccccaaatcccccaaccctcaggccaaacaagataaaaagaaacaagaaaaaagttgtaacatgaaattgacttgttttgcttggaaataagattataaattagtaaatcaaaatcttgacctctcatgataatcgtggtgtgctgcaggcatcacgatgaaggcggggctgtctgcactcctgtgcttgcgacactaatactgttctctccactgcaccggagcacctttgttcggtatatatatgcctttgttacctctgactcacgtcgcttaaagaccagttttgcaaatgttgttttttaaaagcatacttgtcaaaactgtgatgtaagagaataaaatccttggaggccttgatttgaagctgtgaacctgtagcctaccaaggacagtaaaaacattcccgttgtgaacactgctccagaagcagct

SEQ ID NO: 156 - DNA, 655 bp, Homo sapiens
  misc_feature (1)..(655): n = a,c,t, or g
gcggccgccgctcctcccggcaaagcacatactcgctgaactgggaggagtccacaccgcccccacaggacgcagccacgctgaaacccctctggaacagccgctccaggacctgtaccgagttgagccggcagtagccattgagcgggaagcggatgacgtgcgtggggtcctggttccagccggcgttgacggagttgcacatgacgtctccggtctcggggaagacctcctcgatgagggccttctcgccgctgagtgcgatccgctcgcccaagtcgggcgtgacgcgcaccaccaggcagtcacaggcccggctgcggcgccgctgctcctgctcctgctgccagcgctccagctcgcgcaccatgggctggagctgatagtagcgcgcctcctcgtacagcagactgaagtccttaaagtcatccggaagcagcagcttggacgtccgcaggaagctcaggacgtagcggaaaatctccccatcccggtcaatgaaataatgttgcttcaaactgtccaggacgaatgggtcagtgccattgaagaggcggcttatcctggagtcagggtacttggtgagcgtgggccagcttgctgtgtacatgtggccgcccacatcgatgtgcacaggtgcattggnactggtgag

SEQ ID NO: 157 - DNA, 503 bp, Homo sapiens
  misc_feature (1)..(503): n = a,c,t, or g
gtttagtttgaacaatatttaatctctgatgcttcagaaggcactttgagatcttgaagggccttagggttgagtctttgatggtgactatggctccttagggtgctgtgtggatgtacaagagcactggctaaggagaggtggcagcatgcaacaagggtaagaacctcagctctttccctaaatggcaggctgacccggggttagtcacttcccttccccagcagcactgcgtcagagcttctctgaggcccctcttacctctgatattctattaagactggcagaggatgtattgtgtgggttttctatcactggaactgagaaaaatttaaaactacctgcatcagcacagagaagatctgaaacggttcttgggtgtttataaagcccgtggctggngctcccatcttgatgtcagcccagccctggggtcagtgcagactgagatacggagcaggaaagcaggaagaacgggagtagcagagtcagggacgacagca

SEQ ID NO: 158 - DNA, 565 bp, Homo sapiens
ccttttttttttttttttttttttttccagaataccaaagtttattcaaaaagtcaataaaagcacagttttgcaaatttgtctaaaacgccagataatcttgaacaaaaataaaatgtctgaccactccaaaataggaaaagacaatcttgtgcaaatagacatacacagtctaggcattgtggaaactggctgtgttcccagcaagagatactgcaccctcctgaccgagcagtcaggcttccctttcctagccatcctaagttgcgttctaggaaactctggatctcagcctcatctccagctttgcctggaccttgctagggggagggagggacaggagcacagaggaggagaggagagggatgtgatgtctttcttaggaaagaaaaaaaggcacagtgatgagctataaaggtagtgatgagagctataaaggtagtgatgaaagcaaggaataattttcattcaccccaaatcctacggcaagctttgacaatgtaacatctttatcttgtggttaggaaaatggacctagagagattatgtggtttgctcaaaatca

SEQ ID NO: 159 - DNA, 575 bp, Homo sapiens
ctggctcacaactttaattgattgctttccctccactgggcccaccgggtcggcttacatagctcatagctcagtgctgctgaaatagacccagggcaagaaaggtatgaacaaccagtgaatgccactggagcataaatgttcacaaaattgtagagaaggggtgacaagaagcaagcagtggggcagggagtgtcactgatgtccgaaaccccgggtcagaccaacacgcagcacagccactcggccagagagagctgaaccatgccatccttgtcttcgtccagaaggctgaatagtttgaagagggtctccaggcggatcatacaagccacgaagctgtcaaagttgatgccaagcttgctgcacgcattcccgaagggcaatggtctgctgcacctggctgttgagggtgaaacctgccttcctgagggctgtcctcatctcgtgggcatcgatggtgcccgagtggttataatcagtttcccaatagatctcctaaagcaggaaagaaatcccaagtagaaaacaaccattcacggcccctgccagaaccatctccctccaccacactg

SEQ ID NO: 160 - DNA, 497 bp, Homo sapiens
attctgaccaaagcatgatggttattccatttacataggaggtggcattgtagaaaataaaaactttctcaaagagatatgaattaaagaaaagttagagtaaggtgaatacttatttaaacatacctttagagtgagggtaagcccccttcccaacccaaaatgaactgaatgagagagaaaaagaggtccagagtagtttgtggagcgatgtttccatctctaatgccactcagctcaggagcaggcttcagacactgcctttatctttacagaaagccatgggaagggaaatgtctgaggtagagctcagcgttgggcatcatatggctaatcactcagaggtcactaatcactctcccttttcttgtttttcagtgaacgagataattgggagagacatgtcccagatttctgtttcccaaggagcaggggtgagcaggcaggctcccctcccgagtcctgagtccctggatttaggaagatctgatgggctc

SEQ ID NO: 161 - DNA, 500 bp, Homo sapiens
ttttttttttttagaaatttaaaatttagttgaaatataaaataaattattgccagaaacacaaagggcacatgaatacaataggggaaacagcttaatgggtttctgttctctgaaaactcaaggcccatctctgagtgataagagtaccctaacaggcaaagcactctgaggtccgggaccaggaagacagtgctactccacctactggcggtctggcactatctgtaggctggagttgggctggggatggtacattcaaaatggactttggtaaactaggggacaacccagacaaacactgcagaaaggaggaaggactccctttccagcatctcaaattcaaggctccaagttactgggcttgggcaaagtcacacattttctcaacaaaggccaactgctgacaatccaaattttaaaaacactgccattaggccaggcgcagtggctcacgcctgtaatcccagttctttttttaatgaaaagaatttgacatt

SEQ ID NO: 162 - DNA, 787 bp, Homo sapiens
ctgcagcaggagcaggagctgttacccttctaatccccacaatgaccccagcctaataatacaatgatccccaagtagaaccaggggcccaaggccccctcgtcagctgggctcccacctccaagctgacgccctcaaccactctgctggggtgagcaaacccaggccccacagctggctagcgggacatccgtgtccacgattggcgccatgtgttttaagttgcagcgtcaaaaacatgaagagattgctttagcaaatatttacccagtcctgactctgcacatggcatcgttctaggagcccaaagatgttaacttgtttaataatcaagccctgtgaaggagtttatagcatctgtggattttggtacccacggaggtgctggaaccaatcgttgaggattccaaggacaactctatgatgcaggcacacctgtcctagctgctcaagggtcgtgggatgcaggtggcacggtgcacgccaagatggctgtgtccacagaggagctggaggccacggttcaggaagtcctggggagactgaagagccaccagtttttccagtccacatgggacactgttgccttcattgttttcctcaccttcatgggcaccgtgctgctcctgctgctgctggtcgtcgcccactgctgctgctgcagctcccccgggccccgcagggaaagccccaggaaggaaagacccaagggagtggataacttggccctggaaccctgaccctgtgtctcctgcccggtggcagtaacaaagccttctgtctgccc

SEQ ID NO: 163 - DNA, 514 bp, Homo sapiens
aaaggcaaagaaggtttttatttaagtgacaacatttgagagctaaaaaccagctcacatcaaaatcaagacccagttgttgaaatcttttaactccataatgctgtttttgtcttgttagaaatctgatatcttacattagcgtttctaacggattttgtacaaggcagccataaggaatataataaacctttttcaccacagaaccatctgtcacagataatactgaaagttacacacttaggaacagtcagaccacagacaaggtcagactggctgccaccaccaagtaaacaactagaaaaggacagcggggtccaagggtgggggtccctgtgcacgagtcgccctcctctggcctgccccccctcgggtcacctgcttctcctttgccccaaagagggtggagtcaaatgcagattttcctcccaactgcctgttagtgtctcaacaaggagagcagagcccaggtcaggcctcactgcttggacttaaccctaactatgatttttac

SEQ ID NO: 164 - DNA, 571 bp, Homo sapiens
tagtgactcagttttttattgaataaaatggcctacagcctgatgacagtaatatggcccttgggttttgaggaaaatatcatgttgtaggttggccaacaaggagatagcagtccagctgaaatttgttttcttatactggctttaaggcagtgattagaaaaggcctaagaggtgggttctgtaagggattgctggaaggaaagtaggaatatggaaagtcatgagacatatactgtcatctcttcttgcttcctctcaagtcacatgcaaattcagggagagttagtatgaaacacacaatggaaatttgggctctaacatatgcaatctgattcttcatggacttcatttggccatatcagttccaacaatttcagccaatgtttaaaaatcttataagcagataaaattttagtgtttcaacaagccatttcctatctttcattctgaaaatccattttaagtcatttttttaacagcataggggtacaaattcagcttctgtccaatgaaatacagaaaaggatatcacttttgtattagttcaggctgctatgccaaagaacca

SEQ ID NO: 165 - DNA, 559 bp, Homo sapiens
tttttagggtatcaagattttacattactaattctgaattcgttatcctttgctttcagccatattaaaactgaaagccttccatacctgatgtttttctatctcattatacagctttcctgtcagatcttcttttagggtgactttgaagaatcagaacatcagggctccaactctcagtagagccagtaaccagcttcctgatttaaaaaaaatcacctttggcctaattttgtcacttataaacagtggtattgcagtaccctggtatgattagttatgatatgtttaacaataattttaaaataccaaagcttgtgaattattttactttcaaaaaattatgtaggtaggaatggtaattctaaaggcactgtcgtttgcttacacattctaacatatttctaataagaaagtacctgctttcttaagagaaaaagggataagttaccaaaagcagcacgttctcctgggctcataccccggattcatccatgaggccacttccattgtaaagcttttagcatctcttgatttctcttcacactgaggcacaaag

SEQ ID NO: 166 - DNA, 933 bp, Homo sapiens
atggcgctgaggcggccaccgcgactccggctctgcgctcggctgcctgacttcttcctgctgctgcttttcaggggctgcctgataggggctgtaaatctcaaatccagcaatcgaaccccagtggtacaggaatttgaaagtgtggaactgtcttgcatcattacggattcgcagacaagtgaccccaggatcgagtggaagaaaattcaagatgaacaaaccacatatgtgttttttgacaacaaaattcagggagacttggcgggtcgtgcagaaatactggggaagacatccctgaagatctggaatgtgacacggagagactcagccctttatcgctgtgaggtcgttgctcgaaatgaccgcaaggaaattgatgagattgtgatcgagttaactgtgcaagtgaagccagtgacccctgtctgtagagtgccgaaggctgtaccagtaggcaagatggcaacactgcactgccaggagagtgagggccacccccggcctcactacagctggtatcgcaatgatgtaccactgcccacggattccagagccaatcccagatttcgcaattcttctttccacttaaactctgaaacaggcactttggtgttcactgctgttcacaaggacgactctgggcagtactactgcattgcttccaatgacgcaggctcagccaggtgtgaggagcaggagatggaagtctatgacctgaacattggcggaattattgggggggttctggttgtccttgctgtactggccctgatcacgttgggcatctgctgtgcatacagacgtggctacttcatcaacaataaacaggatggagaaagttacaagaacccagggaaaccagatggagttaactacatccgcactgacgaggagggcgacttcagacacaagtcatcgtttgtgatctga

SEQ ID NO: 167 - DNA, 557 bp, Homo sapiens
ttttttttttttttttttttttatagcaaactttttatgtcagaagtttattttattggtaaaatattaaataatatacagaattaaaaactgcacttacacttctgagaagaaataaatcttggacaaattatatgcttgttcctgagattccctaaatttattccagtagctgggcactcagacagtacaaacctttataatataatccttttcacaaagtattacaaagtttctgcagcttctttagttgtacacacatacagacacacactcacacatgcatatacaacactcatacacatatacacagtaaccacatacatgcacagaacatgtatgtgtgtgcattaaaaacaaagaagatacaagtcccacattttagtctgcagtgataaaactatttagcggaggtctccaaatcagtatgtagtagagtgacttgtcacacagctgcaaagactgtttcagtatttccatagtaaacctcattttctgaggtatggtatttgagccttaaaaaaactacattacacttagcaaacctgacatacaag

SEQ ID NO: 168 - DNA, 422 bp, Homo sapiens
tttagattgtgatcactataattgacaaaattgatgttagtgaattatatttacaaacacttcacataaagattctatgtaactgatagttcattttatttttataagccttttgtaaacatactgctatgtaatatgagtatatataacatactaaagaacatatctttttagtccataaccattacttctaatggattataagtatacccagattttgaaatgtatacaaagaaaatttaacaaataataacatgtaagctatacatgtcatattttacctgttacccatcaatctgtttctgtttttaaaacacagttttcaaacactaagtctgtgattaaacaatgacactaaaattaaattgtttatatgtcctacctagttcaataggcttaacaaacatgtatgcatatatgtt

SEQ ID NO: 169 - DNA, 665 bp, Homo sapiens
actattctaaaaatttaagatcatgctattacctttaagaaaaataatagctttacgatggtttttaattctccatatgaaagttaaagacttcctttttggagtccaatggctgttaacataaatctaaatcctgagtaacctacgagatgcagatcacctggccaatcaagaggctccagggacatgtttacgacatggaaaaaccatgggtgttttttgcccaaaaagagtatgttccctgatggaaaaggcaggcttgagttcattatcttgagaacaaagatcaaggcaactgcagtagctgcttacctgtgtggccctgtattctctcactgatttttgctccaaggaggtcccaaacgagcagttcaccagactgactgccagataaaacggaatttccatcccagacaaagcacctgcaagaatgatttagaaatagtcctttcttcatcatgaaggaaggatatgttgaactggccaatgtaagcccaaatgaagtgatcatgaacatgtctgtaaatgtcttcgcccccagtaactcacaaactatacctctggggctcatctgatgtcatggaagagatgagcattcctgtctgcacatcaatgacattaagacagccatcttgtcctgtgctgaggacatggccactatctgc

SEQ ID NO: 170 - DNA, 1933 bp, Homo sapiens
agaagccacattagggccattaaggctgctagaatttagaaagaaaacacacagcctcccagagtgctgggattacaggcatgagccactgctcccagccttccagaggaattttaagcccatgtccaaacattctgtttgtataaatatattctaatttttaaataaatagtttctacttttctgaactttatattttttcttgctataatggattttcataatcagaaaagattaaattagtaatcatgaattgcctttaatatttggcagtaagtcaatgaaataataaggcacttatataccatctttgacatcattaaaagtatcaaatcccattaatctaaaacttctttaagcattttgaaagcagaaaatgtttacatggttctttcagttcctcaggctttttgtctaatgatgcgtgacttaggataagatttgaattaagtgcccagcttgaaacataataatttttctgtataagccacagatcctctacctcctttgtgttaaagcctttatatgaaacaattaagtagaagcattcaatagtgtgtcattaactgttcatactaataaatggatacagcacattttcatggcctgtaatgtagaacatactatataaagttctcagtttggggatgactaggtttctggaaggaatagaatgctaaatcaatggatggcattgggctgagaaacactgctgctactaatcagccttgaatgtgtaatgtgaacatgcaaaagagaacatgcatacactcaaatttgtacaatgctataactggaagttgaaggacttgaatttttatattgtgctattgttatgttttctgtaattgtttatatctaaggaatttttgaggtaatataaaagaaaaagagaataatgaacaatgatgtcactggagggtttttacattaaattagatcatttttcttcttattcacaataataatcttaatctttaagaattaattataatttaatattataattcataatctttaagaattaataattataatttaatattataattaataatctttaagaattaataatataatttaatattataattaataatctttaagaattaataattacaattaataattaataataatcttaatctttaagaattaataataatccttaatcgcaataataatcgcaaggaggagaagtaagtccctcctccttctgtatgaacttttctcccacatgctgctgtatggtttagtgagagtgaagttctaaagaacatcaatatgattggtgggataatccaaagacattttttcagaatcaaatggcatgtcgaaggtttgtttcttgcatatgtatttactggtccacagcacaaaataaagtgaccacatatacataggaaagttgaatttgtacacatacagcatctgaaatgtatctgatgttcagcatcaagatttcactgaacattgtagaaatgtgtatcttttgcatgtatattttacattgattttctatttatgtacatctagaaagttttaaccctaataaatagttttgtaattttgaataatagtgtcagtttatatgtgagggagtagagacagagaggttagcactggataataattagtaaggccaaaggagaaaatttcatagaaaatattgttgttgtcataatgagtacagcatgaaaggcttcctctacaagacactagtcaaagagttgagagctgcggtttctaatctttgtccattactcccttactccctatgagactgtggacctgtcacttggcctctctggtcttcagttttctcaccagtaaaacaaggaacttgaaccaaatgacctctagtgttccccttgggtttaaatgtctataaatgttcaatgactagaaaaaaaaaaaaaaaaaaaaaaaaaaa

SEQ ID NO: 171 - DNA, 1816 bp, Homo sapiens
ggaggccgaggaggcccccggggcccggccgcagctccaggacgcctggcgcggcccgcgggagccagggccagccgggcgaggggacggcgactcggggcgctcccagcgagagggccagggggagggcgagacccaggaggccgccgccgccgcccgccgccaggagcagaccctgcgtgatgccaccatggaggtgcagcgcgggcagttccaggggcggccggtctccgtgtgggacgtcctcttctcctcgtacctgagcgaggcccaccgagacgagctcctggcccagcacgcggccggcgccctgggcctgcccgacctcgtcgccgtcctcacccgggtcatcgaggagacggaggagcggctcagcaaggtgtccttccgcggcctgaggcgccaggtgtccgcctccgagctgcacacgtccgggatcctgggccccgagaccctgcgggacctggcccagggcactaagacgctgcaggaggtgacggagatggactcggtcaagcgctacctggagggcaccagctgcatcgcgggcgtcctggtgcccgccaaggaccagcccggccgccaggagaagatgagcatctaccaggccatgtggaagggcgtgctgcggcccggcacggccctggtgctgctggaggcgcaggcggccaccggcttcgtcatcgaccccgtgcgcaacctgaggctgtcggtggaggaggccgtggccgcgggcgtggtgggcggcgagatccaggagaagctgctgtcggccgagcgcgccgtcaccggctacaccgacccctacaccgggcagcagatctccctcttccaggccatgcagaaggacctcatcgtccgggagcacggcatccgcctgctggaggcccagatcgccacgggcggcgtcatcgaccccgtgcacagccaccgcgtgcccgtggacgtggcctaccggcgcggctacttcgacgaggagatgaaccgcgtcctggccgaccccagcgacgacaccaagggcttcttcgaccccaacacgcacgagaacctcacgtacctgcagcttctgcagagggccaccctggaccctgagacggggctcctatttctttctctctctctacagtgactgggcttcctccgtgcagttttctgcaactctggagaagtggaggcatacttgtgtgtctgggttgtttttttttttgtttttttttttttttgttttgtcattctttaattttgttgttttacccattcgttatctgtggaaaacgttttaagttgtcatgtgacagaaacttttcctttgtccatcgaggtgtttcataagttttttggtgtgttttctgggtcgtctatgtgtcatatggttttacttttctctcctttttcgttttcagaacatttttctgtctgttttggattcactgcttccattttacagaatgtcactctttagactctcagtccatcatgccatcgggtactcttgttgcagtgtaatttttattacatgcggttatttccctaacgatgtgctattcacgttcatcttcaaactcattttccatcagccagtgtctactatttagtgccctggctctatttcggtcctcctccccgggctttccctggctgctgtgctggccaaaagcatgggctttattctctccattggctgctgctccaccttagaggtgtgacctcactagcgttgactgagcgagtctgttgtggagaagaactttttgtagtaatttactaggaaaaattctgaacaagtaaaatatgaaggaaaaaaaaaaaaaaaaaa

SEQ ID NO: 172 - DNA, 1816 bp, Homo sapiens; identical to SEQ ID NO: 171

SEQ ID NO: 173 - DNA, 471 bp, Homo sapiens
ctttttttttctttttgagacagtctcgctctgttgcccaggctctgtcttccaaaaaaaaaaaaaaaaccacacacacacacaaataactgatcattgattctctttcccttcctgcagtctcccaaggtgtcaattaggaagtgccaaaatactaaagtctcatttaattttcctgatcaacttatgttctaataattaatgtggaaggagaggaaagaaagagaaaacaaatgagaatctaaggtagtaaacagcagcaacttagcgggaataaggggaacatggttctcactaaccaaataggactgataacgcttccaaaaaataaaatgttaggtgaagggaaatatggaaatatgttttactttctactaatagctgcaggcaggaaggtccaaacgcagggtttaactaagctgggggagtaggggagatgtttagagggaatactgaaagagaatcagtttc

SEQ ID NO: 174 - DNA, 720 bp, Homo sapiens
aagataacatgcctgagggagagcctggtgcctttgctatgaattaatatgcactttctgaaaactctaaagcctgggaaacattttagtttttgttaaggttctaaactgtgctacagatacttgtaagacttttaaaatcgagagtaagtatgttcttacataaggcctttcttaggaattatgtgtatataaatctttgaaatatctttatatacctgagttttaggttccaactgtgttagacatgagttagctagatccatggtctctagatggtttacttaaataggccaggcgcagtggctcacacctgtaatcctagcactttgggaggccgaggtgggcagatcacgaagtcaggagatcaagaccatctggctaacagggtgaaaccctgtctctactaaaaaatacaaaaaattagccaggcgtggtggtgggtgcctgtagtcccagctactcaggaggctgaggcaggagaatggtgtgaacccgggaggcagagcttgcagtgagccgagatcgcgccactgcactccagcctgagtggcaaagtgagactctgtctcaataaataaataaataaataaaaataagcctgtggctgtttgagggaaaagtaacatagtctgataattaattatgataataatatgatagttaaaaatacgtcattttaaacgatttcccagacacacactaaattgggtttatgaa

SEQ ID NO: 175 - DNA, 400 bp, Homo sapiens
ttattgttttttaaaaatacaattttgaaatttattgttgaaaatggacacatggaacaaaccaaaccttgttttatcatgtaattttcagaaaatatgtgatccataaagattaaaagaaagttgtattaagtctggcagctttagtattaacttgaaataaaatatggcaagctttccacgtcctcctttatttccacaatccatatgtacgagctagattccagtcagaacttccacaaatacttcactctttggtagcagcggttataaattacgcctttgctaatttgcgttgttcccaaccaggagaaacattaccacaaaaaaagtcagtttcatcctgcagtgttcccgcagcaaccatattaaagctgaagaataaagctcctttgtagta

SEQ ID NO: 176 - DNA, 222 bp, Homo sapiens
tttttttttttttttttttttttttttttttttttttttcctttgacagtgaccatttattacacacatcagactgggggaagaccattgacatagctgagcaccaggtagggtgtcctgggtattcgggcatgagagcagcaggggcctcctgacgcgggcaggagaaacatggcacccaccaggaggaggaagaggaggaagaggataaggaggaaggtc

SEQ ID NO: 177 - DNA, 559 bp, Homo sapiens
  misc_feature (1)..(559): n = a,c,t, or g
aattcgcggccgcgtcgacgctgcgagaagacgacagaagggccattctactaattttaaagaacatcttggaattttacactcttggaatcatagtcgtagaatcctttttttgagacagagtctcactctgtcgcccaggctggagtgcagtggccagatctcagctcactgaaacctcagcctcccaagttcaagtgattctcgtacctcagcctcctgagtagctggaattccaggctgtactcactgctttgctcatatccccgctcattaccagggacaggccagcacccctggcattgcatctcacatatccactgatggatggagaacagactgaaattcagtgccttagagaccacacactccaaccccctcattgtgcagatgggaaaactgagagccatagaagggaagtggcttgcccaaagccacacttactgttttccccacactgtaccacaaactttcaccattcttcaggtttggaaaaatactaataaactgatcaacactaaaaaaaaaaaagcggccgctcggttgtngcgcggccggg

SEQ ID NO: 178 - DNA, 421 bp, Homo sapiens
aattttcaaggcttttattggctgtagaaatggtctgggagacaaatgtcctaaaaatccccaatttcccttaactggcttcacaatctttggcaagtcactttacctctctgagcccccatgccctcatctctgcactaggtctgccttgacacttttgtttgcagggtttaggaccagatggaagtgccttgtaaactgaaaaataccacattatatatcatatcacattattatactttctgataaatggttacaaagctatctgaaatagaagtttacattttatttctgattaactttcaatattaagtgatagaacctaagaagcaaaagcgaacataaaattcaactggaaaatttgaaagagaaatggttttttctctaggaaatttgcactaataactttttcccaccatcc

SEQ ID NO: 179 - DNA, 462 bp, Homo sapiens
tttcactttttcattattttattgttgttttagtagcattttgaggtgaatgtatgcataatcagtgaattagacaagcatgcacatacatgatatctgatcaaacatttttttgtctctcatcatcctcataaaatttattcagtgggagaagctttttcttccatcagatacattccagttgtatgccaacatactcaggtaagagcaacattttggtcattttaaatagtttggtaattatgactcccagtcgcctacaataagaagaaactacaataatttagtactaaatttttcttccctctccaactgagtcttgtgttgagttgcctacttgcgctagcacatcttcccttgctggttgacatttttgctaagatttctccctctccttccaccccaccttggacacggaggtttctggcctccctttccccaggtccccaaaaaagaaatctg

SEQ ID NO: 180 - DNA, 526 bp, Homo sapiens
tttgacattttgtttattttattttaaatattaatatattcctcaccttgttctggggaggatttgagactgctcatatgatatgcatgccataaattagtaaaatgcaataaaaaataaagcatcagaccacagaaactatgccatgggtggtatagcaggccgtaggcggctgtaaagttgatccggaattggccttcagtctcttagtggtcaactgaaagggtgttgtggtcacatacatggctctcattcacaagagggcaatgtaccagctcttagaagaagcaaaactttttctagtacttgactctaaggaaaattacccacctcggcccagatgaaagagactagcgtggataatgtcctcaaaacatggcagcaaattcaggctcagtttctctgggctgtgtcctgcaggaagatccaaggtggtcaccctcagcctctgctcagtgagagcactgaaatccacactcccttgagcaaagaaacgatctgtatgtttcaattctttcttcagcac

SEQ ID NO: 181 - DNA, 350 bp, Homo sapiens
ttttttttttttttttttttttttttttttttttttttttttttttttttttggaaacagggcctcgctgggtggccctgactgctctaaaactccggagttaaagggatcctcccacctcaccctcccaagtagctgggattacaggcatgtcccactgggcctagctgaaacatcagtttctgactgaaggggaaactacaacaactttagggtttcccttaaaaggattacggccatggggaacttgactgagtaaacaaggctataaataaaaagcttttccaaaacattaaccatgggaagcatcattatccccataaaaggggggcatccaggttaaatggccc

SEQ ID NO: 182 - DNA, 400 bp, Homo sapiens
tttttttttttttttttcactttttaaaaatctttattaataaagtaattcattataatttttgaaaaaaaaaagttttaaaatggtctgccaacatgttaatgtaggttaggccatccaaaagacaaagcaaaacatcaacattaagtcataggctaggattatacaaatgagaacccccaccttatacattacttaatataagttaactacaaagagcctctccacttacatttttatcatgcatcttacatttaaaggcccttattcttttatagaaaaggtcataatacccaataaaaaagaatctgtaatatccctgatgcagcaacaattgatcacatgctttcacatgtgaccacaataggaataaaataacagcgtaaagaaatttgaaagt

SEQ ID NO: 183 - DNA, 336 bp, Homo sapiens
aaccggtccttctccaacctccaacttttggtttttggaaaaatgtttctctaacacctcaacagtttaaggtaatttagtacacatatatcagtattttggtgatctgaaaaagcaacccattttctaaattcatatttttcctaaaactttactatgtttttattttaagaggttcctgttatatacactttttacacatgcaaataaactttataccaagtgagtaaaaaaaaaaaaaaaaaaaaaaaaaaaaaaaaaaaaaaaaaaaaaaaaaaaaaaaaaaaagaaaaaagaaaaaaaaaaaaaaaaaaaaagaaggaaaaaaaaaaccaa

SEQ ID NO: 184 - DNA, 628 bp, Homo sapiens
  misc_feature (1)..(628): n = a,c,t, or g
cggcaaaaggggaagcccaaggcgtaatttgggtaccnccaggcacaagtccgaccgttgtaaaacggcggccagttaatttttttatatttaaaaagggtgaggataagatagagaaagtgtttttttttttttagaaatcccacattttaatacattgccatgcacataaggagtcaagtaatgctgaatacaaaatagtcaaatatccaaaatgataaagcagattttccagcctgatagagatcatgctcacagatacaagggaggcaaacatctgtacagtttcatttttatccattttataagagtcatgcccccctcaactctttttgaggacaactggaaacagaaggaaacataagaatatacaaaggagacccaaagggaattggcaagttgatagctgctgaagatatggaaatcggtggttcaaaattgtggtacacaataattcttatgtttagagaaaaaaagtttctaaacatcttatgccctggaagccaggaaactaaagtggatatccaacagaaaaggcactcttgttttaccacataacttgattgcctcctcctaagtctagtcctgggagtttttctaggatgcacagaggaaaaaaaaaaaaaaa

SEQ ID NO: 185 - DNA, 997 bp, Homo sapiens
cattagaacacaccatacaaatgttagttctatatggccaagacatctgatttaaatttgatgaaacacagcatgtcattgttttctagaacttaaccattttcgcttctagaatttcagtatgattgtaggcaatgccactgaggcagctgtgtcatccttcgtgcaaaatctttctgtcatcattcggcaaaacccatcaaccacagtggggaatctggcttcggtggtgtcgattctgagcaatatttcatctctgtcactggccagccatttcagggtgtccaattcaacaatggaggatgtcatcagtatagctgacaatatccttaattcagcctcagtaaccaactggacagtcttactgcgggaagaaaagtatgccagctcacggttactagagacattagaaaacatcagcactctggtgcctccgacagctcttcctctgaatttttctcggaaattcattgactggaaagggattccagtgaacaaaagccaatcaaaaggggttacagctatcagattaaaatgtgtccccaaaatacatctattcccatcagaggccgtgtgttaatcgggtcagaccaattccagagatcccttccagaaactattatcagcatgggctcgttgactctggggaacattctacccgtttccacacaatggaaattgtcaggtcaatggacctgtgatatccacggcttattcaaaacttattccataaatgaagctttctattttttccaagatagaagtcaaactgaaggccagctcaatgtctgtatggggacttcaatcctttggcggtggaagcatgccaggttgtcacctattgaaagtgaactaagaacattggtgacggtgcccatgttactcacatgaactcctctcacgattgtgtccccatttggtcacctctacaaattttcccgctggacaactgtgtaccacatgtgggacacggtatccccggacacacactaagacg

SEQ ID NO: 186 - DNA, 447 bp, Homo sapiens
  misc_feature (1)..(447): n = a,c,t, or g
tttgattgaaaaaaatatgaaatttaattttagacatggcaagttcaattacatcacttcatatcacagtagaaaatataatttgttctaccatgggaaatagtataatggaatagatcacaatagtagtataataaaatagaatatccaagtgcaaaaacaattttcaagtaagtacacacactgtttgaaggtactttattaagatcaaagatttttcattacatttatttataaatccttcctagtcaaaataaaataataaaaatctgtatctttagaaagaacatagttttgtaagtctgagaaggttatgtttgtcagtttcaaattattacagtttagatacattcaatcattacacaataccaggaaggtcagccttaaagataccaagaacttccatanttgtcagtaaaataagggtaaaaaattaaattttacttt

SEQ ID NO: 187 - DNA, 521 bp, Homo sapiens
  misc_feature (1)..(521): n = a,c,t, or g
agcgcaganngncagangcngananaaatcactaccaatataatggattttatatatcagattgctttattctggatatcatggtaacaatacagaaagtatacataatttcccatttctgcaagtagtcatgactgctgaagaaagaaaaacttaaagctacggcagaattattttatcggaaattctgattttgtttttaatttttgataactttttactaaaggtatgaacacacaaagagcttattttgttaggcaaatacacattaataagaatgcctagaagaggactgattcttcacacccggacccactggttgctgttgggccttgctttgctcttgcagtttggtattatttatgtacctcctggaatgtgccccccagactgatggaaatgcatctcttcctgggtgttgttggggaaaattatggtaaagagtattatcaagccctcctacaggaacaagaagaacattatcagaccagggcaaccagtctgaaacgccaaattgccca

SEQ ID NO: 188 - DNA, 342 bp, Homo sapiens
tttgacacttgatagatgtttttattgaaattccttcaccaaaggaatatttacttgtgaatctctaagcccacacacatacacaaataccattctgtacaaacatacgtatttaataatttgattcttctgctcaatactcaaagggggctgggaggaacagtttgtctcctagggcatgacatagactggacagtctttttataagagtgatacaactgggaagggagaacgctgtttcagaagataactcagatcctcttcttcaggaaagactgagtttggaacaccagggctttttttttttttttttttttttttttttttttttttttttttttt

SEQ ID NO: 189 - DNA, 710 bp, Homo sapiens
gaaacatagaagaagcattagccccagtttgtataaaatgtctgctgcaactgaattcatgatagttcatgaaaactgaaaatcattccaattttgtaaaactgctgctactggttttatcaataaagttttagcagatggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaactcaaggggcaacccaatgcccattataacaaaaagaaaaaacttttaaaagccctggcgggacccaattaaaccttactggcgggaaaaccccttttttccccctgttttaatacctggcaggccttgcaaatatcgccctttccacaatttgccaacgtgacggaccaatgcctttttccaaacggttatataccctaaaggcccactggaaaaattctttccaaaaaatgtcaggttaaaaaaccgggtaaaccgaattgtgaaacacccctctttttttcacaatattgccccaaaaatttgtgataacctcgtgtgactctttcggaaccaacggggccaacttgttaaaaacttcgtcctactacggaacaagtggcccacaattggggaaccatggctttccccttttacgggcaaaatacccctttataaggacttttggcccccttcgtgacgcg

SEQ ID NO: 190 - DNA, 427 bp, Homo sapiens
ggtaagaaaagaacattttatttccagtctattacaaacagtgtctgggtttagaaacagccgacagtgaagggacaaagaggtgttcacagggagctgctgggctgtggtcagggcaggctccaggctgtgcaagaggaagccacccagggcaggggacaatgggcccaacacagccccacctccgacgcaggggctgaggcctgggccaggggaaacacaggccaagccagcctttggccctgcgaggaggttcagacaagagccagcggagctcccaccaggggcccgaggcacggcgcctctcccagtggggtcagcaggcgaggctgctctgaggacaccacctgctcccggaaccttcccacaagggcttcactggggaacagtggggcccagaacccagagaccccgcaagccacacagc

SEQ ID NO: 191 - DNA, 504 bp, Homo sapiens
ttttttttttttttttgagacgagtctcgctctgtcgccaggctggagtgcaattgtgcaatctcggctcactgcaacctccactccagcctggtgaaagagcaaggttccgtccaaaataataataataataaaataaaatattctaaaagtatgacgtcaagatggccttaaaaaaaaaagctttatggaaaactgtgacaggccatatacaaatgtgaggtattcatcacccaaagatgccatttgctgagcaactactaagcgctaggcacgtgctggatgctttgcctaaatcagtatgtcaccaccacaagaggccttccctgactaccctgttaaagtaaatccactcctctccccactcgctagttattctctcacgttccctgttttttccttcttactactccttgtaatttatgatgtttttgtgtgctttttcaatcctcttccaccagacagactattagcttgccatgaacaggagtcatgttggtgagc

SEQ ID NO: 192 - DNA, 321 bp, Homo sapiens
ttttttttgcaagaaatcataattttgctgtctcaaagaaactttataacttatttacaaagtttttttcccaagatacaaagcaataagttaacattctcaatataaaactaaactttgacattttgaacacaaaacacagttgtttttagggggtcacattttccaaatttcacaagaaaaatgtcaagattctcatttcacaaagcatggggttttacagccacacaacagaacgcaaaaaggctaagcttgtgcaacatgtttccagaacaacaataataacaataataataataacaataatatgtacagtcatta

SEQ ID NO: 193 - DNA, 469 bp, Homo sapiens
ttttttttttttttttttggagacagggtctcactctgccacccaggcgggagtgcactgccatgatcacggctcactgcaatctcaacctcctgggctctggtgatcctcccacctcagcctaccaggtagctgggactacaggcacacaccaccacacacagctaacttttgtaattttagtagagatagggttttggcacgttgcccaggctggtctggaaatcctgggctcaagtgatccgcccaccttggcgtcccaaagtgctgggattacaggtgtgatctaccgcgcccggaccacctgcacatttaaaattgtgaacctctctgtatacttcagtaacttttcaaagatttctttgacacaaagttctcagaaatcttaaagctagcatttcacaacagaaaaaaagagcttctggttcactggtgaaattttactaataaaatttaaaaacaaaaagct

SEQ ID NO: 194 - DNA, 513 bp, Homo sapiens
tttttttttttttttttttttgagatgaaaaaaaaataccatattttattgattccaggttcttgcagtaatcaaacagataaaagatcctttaatactggtgcttggacagggttttacaaaacagaaagattatgcaatacttaatatttggtaacaatttttagcacatagtaaatattttattactttgggtaataaacattctgaaaaataaattctttcattatgatataacttatgatcctcaccctaacatggctatgttctctaattactcctttgtaagtaaaatcataagtaataatagttgtaatcacaagtaatactagttttaatcataatacacacataattttgaatcctgatttttctacttaaaagtatgtaatgaccatgttactatcttgctacataattttcataatcatcatttgaaaattgtacattgtacctgatcatatggatataccataaatcacaaaccacagctataccatattatcctaggca

What is claimed is:

1. A method to select a lung cancer patient who is predicted to benefit from therapeutic administration of an EGFR inhibitor selected from the group consisting of gefitinib and erlotinib comprising:
  a) detecting the level of E-cadherin polynucleotides in a sample of tumor cells from said patient;
  b) comparing said level to a level of E-cadherin polynucleotides in a sample of tumor cells from a subject having lung cancer that is resistant to gefitinib; and,
  c) selecting the patient as being predicted to benefit from therapeutic administration of an EGFR inhibitor, selected from the group consisting of gefitinib and erlotinib, if the level of E-cadherin polynucleotides in the sample of tumor cells from said patient is higher than the level of E-cadherin polynucleotides in the sample of tumor cells from the subject that is resistant to gefitinib.

2. The method of claim 1, comprising detecting expression of the E-cadherin polynucleotide represented by SEQ ID NO:3.

3. The method of claim 1, wherein the EGFR inhibitor is gefitinib.

4. The method of claim 1, wherein the EGFR inhibitor is erlotinib.

* * * * *

UNITED STATES PATENT AND TRADEMARK OFFICE
CERTIFICATE OF CORRECTION

| | | |
|---|---|---|
| PATENT NO. | : 8,017,321 B2 | Page 1 of 1 |
| APPLICATION NO. | : 10/587052 | |
| DATED | : September 13, 2011 | |
| INVENTOR(S) | : Paul A. Bunn, Jr. et al. | |

It is certified that error appears in the above-identified patent and that said Letters Patent is hereby corrected as shown below:

In the line following the Cross-Reference to Related Application, please add the following:

--GOVERNMENT INTEREST
This invention was made with government support under National Institute Of Health (NIH) grant No.'s CA-058187 and CA-085070. The government has certain rights in the invention.--

Signed and Sealed this
Third Day of January, 2012

David J. Kappos
*Director of the United States Patent and Trademark Office*